(12) United States Patent
Chada et al.

(10) Patent No.: US 7,879,544 B2
(45) Date of Patent: Feb. 1, 2011

(54) METHODS OF IDENTIFYING ADIPOCYTE SPECIFIC GENES, THE GENES IDENTIFIED, AND THEIR USES

(75) Inventors: Kiran K. Chada, New York, NY (US); Roland Chouinard, Piscataway, NJ (US); Hena Ashar, Edison, NY (US); Abu Sayed, Cincinnati, OH (US)

(73) Assignee: HMGene Inc., Piscataway, NJ (US)

( * ) Notice: Subject to any disclaimer, the term of this patent is extended or adjusted under 35 U.S.C. 154(b) by 1830 days.

(21) Appl. No.: 10/630,423

(22) Filed: Jul. 29, 2003

(65) Prior Publication Data

US 2007/0178472 A1    Aug. 2, 2007

Related U.S. Application Data

(60) Provisional application No. 60/398,785, filed on Jul. 29, 2002, provisional application No. 60/478,206, filed on Jun. 12, 2003.

(51) Int. Cl.
*C12Q 1/68* (2006.01)
*A01K 67/027* (2006.01)

(52) U.S. Cl. .............................. 435/6; 800/18
(58) Field of Classification Search .................... 435/6; 800/18

See application file for complete search history.

(56) References Cited

U.S. PATENT DOCUMENTS

2002/0155472 A1 * 10/2002 Czech et al. ............... 435/6

FOREIGN PATENT DOCUMENTS

WO       0061631       10/2000

OTHER PUBLICATIONS

Soukas et al. (2000) Genes and Development, vol. 14, 963-980.*
Anand et al. (2000) Nature Genetics, vol. 24, 377-380.*
U.S. Appl. No. 10/143,610, filed Jul. 31, 2003, Haiyan Xu.
Jaubert et al. Proc. Natl. Acad. Sci. USA 96:10278-10283 (1999).
Matsukawa, et al., Proc. Natl. Acad. Sci. USA 96:7403-7408 (1999).
Flier et al., "Leptin Expression and action: New experimental paradigms", PNAS, vol. 94, pp. 4242-4245 (Apr. 1997).
Samad et al., "Tissue factor gene expression in the adipose tissues of obese mice", Proc. Natl. Acad. Sci. USA, vol. 95, pp. 7591-7596 (Jun. 1998).

* cited by examiner

*Primary Examiner*—Anne Marie S Wehbe
(74) *Attorney, Agent, or Firm*—Gary J. Gershik; Cooper & Dunham LLP

(57) ABSTRACT

Disclosed is a method of identifying genes that are overexpressed in adipose tissue as compared to pre-adipocyte tissue or other tissues comprising performing differential gene expression analysis between the white adipose tissue (WAT) or stromal vascular tissue (SVT) from any two different mice selected from the group consisting of wild-type, HMGI-C –/–, ob/ob, and HMGI-C –/– ob/ob genotype mice. Based on this method a number of nucleotide sequences are identified whose expression is adipocyte specific. The identified nucleotide sequences and their corresponding polypeptides are then used to prevent adipogenesis, to treat diabetes, and to screen for small-molecules that can modulate or prevent adipogenesis and to treat diabetes.

3 Claims, 8 Drawing Sheets

METHODS OF IDENTIFYING ADIPOCYTE SPECIFIC GENES, THE GENES IDENTIFIED, AND THEIR USES

This application claims benefit of U.S. Provisional Application No. 60/398,785, filed Jul. 29, 2002, and U.S. Provisional Application No. 60/478,206, filed Jun. 12, 2003, the contents of both of which are hereby incorporated by reference.

Throughout this document various publications or patents are referenced to describe the state of the art to which the invention pertains. Each of the referenced publications and patents is incorporated by reference herein.

Nucleotide and amino acid sequences referenced in this document as "SEQ ID NO: _____" are submitted in computer readable form as a Sequence Listing under 37 C.F.R. §§1.821(c) and (e). The contents of the compact disk labeled with the details of this application containing the file name "69014-PRO2.ST25", created on Jul. 29, 2003, and having a file size of 1,142 kilobytes, which is the computer readable form of the Sequence Listing, is incorporated by reference herein. (Nucleotide sequences are numbered as SEQ. ID. NO. 1-279, and their corresponding amino acid sequences bear a SEQ. ID. NO. that is 500+ the number of the nucleotide sequence. For example, the amino acid sequence SEQ. ID. NO. 501 is encoded by nucleotide sequence SEQ. ID. NO. 1.)

FIELD OF THE INVENTION

The present invention relates to the field of molecular biology, human metabolism and physiology. In particular, this invention identifies which known genes are adipose tissue specific, and provides novel genes that exert influence directly in the adipose tissue and which play an important role in the regulation of obesity and activity in adipocyte differentiation and obesity.

BACKGROUND OF THE INVENTION

Obesity, or an excess of body fat relative to lean body mass, is a serious health problem in the United States and abroad. A person is clinically obese if he or she has excess adipose tissue. More particularly, for purposes of the present invention, a person is obese if the person's body mass index equals or exceeds 27 kg/m$^2$ and the person has excess adipose tissue.

Statistics suggest that more than 25% of the United States population and 27% of the Canadian population are overweight. Complications of obesity include, among others, diabetes mellitus, hypertension, hyperlipoproteinemia, cardiac diseases (atherosclerotic disease, congestive heart failure, etc.), pulmonary diseases (e.g., sleep apnea, restrictive lung disease), cerebrovascular injury, cancers (including breast, uterine, colon, and prostate), gall bladder disease (stones, infection), toxemia during pregnancy, risks during surgery (e.g., pneumonia, wound infection, thrombo-phlebitis), gout, decreased fertility, degenerative arthritis, and early mortality. Psychological complications of obesity include poor self-image and poor body-image. Social complications of obesity include discrimination in jobs, education and marriage. Despite the known associated risks, a significant portion of the population is unable to lose weight or maintain weight loss. Obesity is now considered the second leading cause of preventable death in the United States, second only to smoking, with an estimated 300,000 deaths annually. Accordingly, reduction of the prevalence of obesity in the adult population to less than 20% is included by the US Department of Health and Human Services among the national health objectives.

The human tragedy notwithstanding, the monetary costs of obesity are staggering. The total cost attributable to obesity in 1995 has been estimated to be in excess of $99 billion, with approximately $ 51.64 billion paid in direct medical costs. Overall, the direct costs associated with obesity represent 5.7% of the annual United States national health expenditure. Thus, it is clear that the magnitude of this problem produces a significant demand for safe and effective treatments for obesity. Obesity has a number of known and suspected etiologies. See A. Sclafani, "Animal Models of Obesity: Classification and Characterization," Int. J. Obesity 8, 491-508 (1984); G. A. Bray, "Classification and Evaluation of the Obesities," Med. Clin. N. Am. 73, 161-184 (1989). While it is generally known that overeating and inactivity are factors that lead to obesity, there is substantial evidence of genetic contribution to obesity. Although the molecular characterization of genetic pathways associated with obesity is incomplete, several recent advances into the elucidation of these pathways have been made. Research indicates that there are several genes that act independently or in combination to modulate metabolic pathways associated with excess adipose tissue accumulation. The presence of these various pathways suggests a complex system of obesity regulation, a system that has not yet been fully defined.

Some mouse models for obesity include obese (ob/ob), agouti (Ay/a), tubby (tub), fat (fa/fa) and diabetes (db/db). These models have proven to be effective in the molecular characterization of these genetic loci because of their ability to simplify the heritability of complex traits.

One gene responsible for the autosomal recessive mouse obesity mutation tub has been identified by positional cloning and shown to be associated with maturity-onset obesity (U.S. Pat. No. 5,776,762). Identification of the tub gene and the protein it encodes may lead to the development of agents that will function to modulate either the protein or gene expression. However, a disadvantage of this system is the ubiquitous nature of the gene, in that the gene is expressed in high levels in the brain, eye and testis, and at lower levels in various adult and fetal tissues, including small and large intestine, ovary and adipose tissue. Although the gene may be used as a probe for identification of other tubby polypeptides, development of agents to modulate the expression of these polypeptides would not be specific to a particular tissue.

Similarly, the ob gene has recently been cloned. The ob gene encodes a protein known as leptin, which has been implicated in an energy feedback loop responsible for controlling vertebrate energy balance. Serum levels of leptin are increased proportionately to excess adipose accumulation as a result of increased expression in hypertrophic fat cells in obese patients. In vitro studies have indicated that insulin and glucocorticoids upregulate leptin mRNA expression in a synergistic manner. The subsequent expression of the protein product thereby functions to stimulate metabolic activity. The promoter of the ob gene has been cloned and is a candidate for pharmacological control (U.S. Pat. No. 6,124,448).

In addition to cloning the promoter of the ob gene, attempts at obesity regulation have also been made through modulation of the ob gene. The ob/ob mouse is a model of obesity and diabetes that carries an autosomal recessive trait linked to a mutation in the sixth chromosome (Yiying Zhang et al. Nature 372: 425-32 (1994). Pharmacological agents have therefore been developed to mimic the action of the ob gene encoded protein and assist in regulation of appetite and metabolism. However, the majority of obese humans actually have normal or somewhat elevated levels of leptin as compared to lean humans leading some to hypothesize that human obesity may be more related to leptin resistance rather than leptin deficiency. Recent clinical trials have shown that leptin may be useful for a certain subset of patients, but not for the treatment of obesity generally (Gura, T., Science 1999, 286 (5441): 881-2).

Using molecular and classical genetic markers, the ob and db genes have been mapped to proximal chromosome 6 and midchromosome 4, respectively (Bahary et al., Proc. Nat. Acad. Sci. USA, 87:8642-8646 (1990); Friedman et al., Genomics, 11:1054-1062 (1991)). In both cases, the mutations map to regions of the mouse genome that are syntenic with human, which suggested that if there were human homologs of ob and db, they would likely map, respectively, to human chromosomes 7q and 1p. In fact, the human homologs have been positionally cloned—OB (the human homolog for ob) has been cloned to human chromosome 7q31.3 (Isse, et al. J Biol Chem 1995 Nov. 17; 270 (46): 27728-33). LEPR (the human homolog for db) has been mapped to human chromosome 1p31 (Thompson, et al. Genomics 1997; 39(2):227-30). Defects in the leptins receptor gene results in obesity in other mammalian species: theta gene in the rat encodes the leptin receptor.

Further, a method for detecting differential expression of specific gene loci has been suggested as a method for identifying a compound that modulates gene expression, but specific proteins and pathways have not yet been identified.

Traditionally, pharmacological approaches to weight loss or prevention of weight gain have relied either on reduction of food intake or on reduction of nutrient absorption. Drugs of the first group, which include Redux (American Home Products) and Meridia (Knoll Pharmaceuticals), affect neurotransmitter activity in the brain, resulting in appetite suppression and decreased food intake. While effective in producing a moderate weight loss in some proportion of patients these medications are associated with a number of adverse side effects.

Drugs of the second group, including Xenical (Hoffmann-La Roche), reduce total absorption of fat from the gastrointestinal tract. However, inhibition of fat absorption by this drug can lead to avitaminosis since successful uptake of fat soluble vitamins from the intestines is impaired in the absence of fat. Additionally, these drugs produce unpleasant side-effects, such as steatorrhea, which reduce patient compliance. Other health problems have been shown to stem directly or indirectly from use of the drug as well such as an increased incidence of breast cancer.

Consequently, focus has since shifted away from these group one and two pharmaceuticals and instead towards targeting suppression of gene expression or protein inhibition. Some pharmaceutical examples are leptin (Amgen), leptin receptor (Progenitor) and tubby (Millennium Pharmaceuticals). However, expression of these genes is not limited to adipose tissue and many specifically act on the brain to stimulate or decrease adipose accumulation. Therefore, it is possible that development of drugs to specifically target the central nervous system (CNS) to interfere with the CNS-active pathways in obese patients may produce similar side effects to those appetite suppressors that are currently available. Thus, it is extremely beneficial to target adipose specific genes or the proteins encoded by such genes.

Recently, high mobility group I-C protein (HMGI-C) has been associated with obesity. Obesity induced by two independent methods of obesity induction, a high fat diet and leptin deficiency, is alleviated by a partial or complete absence of HMGI-C making HMGI-C a candidate target molecule for obesity. For example, studies indicate that HMGI-C is epistatic to Leptin (Lep) in fat tissue, where Leptin deficiency has been associated with the induction of weight gain (U.S. Pat. No. 6,124,448).

However, closer observation reveals that ob/ob mice are not the classic epistatic relationship because other phenotypic features of ob/ob mice are still observed on the HMGI-C$^{-/-}$ background. This suggests that HMGI-C and leptin function in independent genetic pathways. Proliferative expansion of undifferentiated pre-adipocytes requires HMGI-C expression. The adipose tissue of mice deficient in both HMGI-C and leptin is composed almost completely of differentiated adipocytes, whereas mice deficient only in HMGI-C have adipose tissue composed almost exclusively of preadipocytes. As described herein, these mice have been found to provide a model system to dissect the genetic pathways in adipogenesis and to thereby identify genes associated with obesity.

SUMMARY OF THE INVENTION

This invention provides a method of identifying genes that are over-expressed in adipose tissue as compared to non-adipose tissue comprising performing differential gene expression analysis between the white adipose tissue (WAT) or stromal vascular tissue (SVT) from any two different mice selected from the group consisting of wild-type, HMGI-C −/−, ob/ob, and HMGI-C −/− ob/ob genotype mice. Based on this method a number of nucleotide sequences are identified whose expression is adipocyte specific. The identified nucleotide sequences and their corresponding polypeptides are then used to prevent adipogenesis, to treat diabetes, and to screen for small-molecules that can modulate or prevent adipogenesis and to treat diabetes.

BRIEF DESCRIPTION OF THE DRAWINGS

The following drawings relate to an embodiment of the invention.

DETAILED DESCRIPTION OF THE INVENTION

Figure 1:
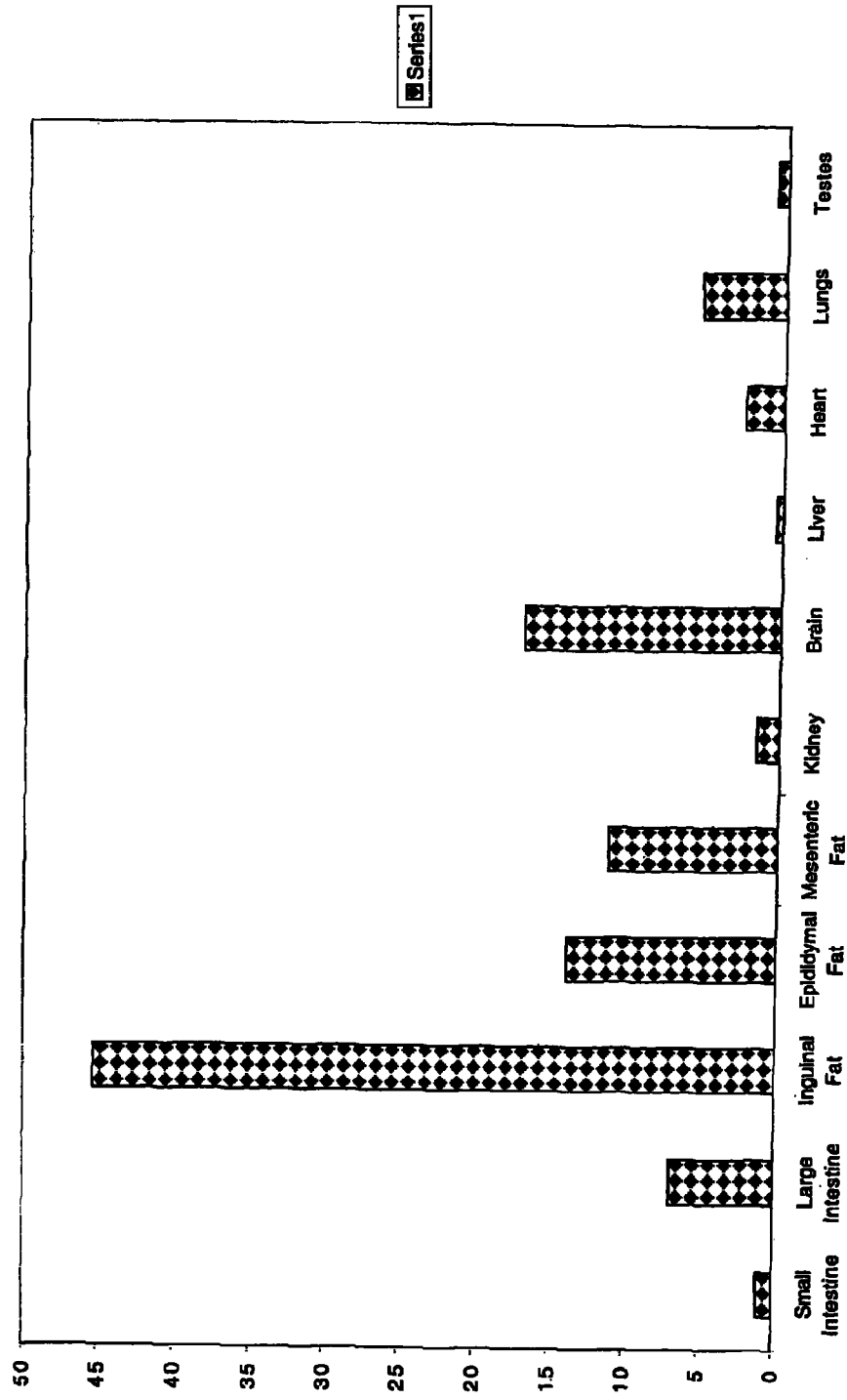
FIG. 1 represents the tissue distribution of sFRP-5 expression in wild-type mice

This invention provides a method of identifying adipocyte specific genes and proteins encoded thereby. "Adipocyte specific" refers to genes that are preferentially expressed at a higher level in adipocytes when compared to their expression, if any, in other tissue. An aspect of the invention relates to methods for using adipocyte specific polypeptides and polynucleotides, including the treatment of obesity, hypertension, cardiovascular disease and diabetes. The present invention is also implicated in diseases and conditions such as obesity, hypertension, cardiovascular disease and diabetes, among others. In still another aspect, the invention relates to methods to identify agonists and antagonists using the materials provided by the invention, and treating diseases or conditions associated with obesity, hypertension, cardiovascular disease and diabetes with the identified compounds. Methods of using the inventive polynucleotides and polypeptides as pharmaceutical formulations in the treatment of obese patients are also provided. Still further provided in the present invention are methods of screening individuals for predisposition to obesity using polynucleotides and polypeptides of the present invention.

As described, obesity is a condition resulting from an overaccumulation (hyperplasia) and hypertrophy of fat cells. Due to an increase in energy intake, preadipocytes enter into a program of proliferation and differentiation to mature adipocytes. This differentiation of preadipocytes into mature adipocytes is accompanied by adipocyte hypertrophy resulting from an increase in glucose uptake, resulting in increased lipid synthesis, primarily triglyceride, and accumulation of that lipid as a droplet in the cytoplasm. The process of the development of obesity is complex, and there are several levels at which the development and maintenance of obesity may be affected. These could be at the level of differentiation from preadipocytes to adipocytes/cell cycle, accumulation of glucose/lipogenesis, lipolysis (the breakdown of fats to be burned as energy), signal transduction, apoptosis etc. The method described herein to identify obesity targets has identified obesity targets in the categories described below.

Genes Known to Play a Role in Adipocyte Biology

Seq ID Nos. 113-114. Kruppel-like Factor 15 (KLF15).

The entry of glucose into the adipocyte requires the activity of the insulin sensitive glucose transporters. GLUT4 is the main insulin sensitive glucose transporter and is expressed predominantly in adipose and muscle tissue. KLF15 is highly expressed in adipocytes in vivo and is induced when 3T3-L1 are induced to differentiate into adipocytes in vivo. Overexpression of KLF15 significantly increases the expression of GLUT4, therefore KLF15 is an important regulator of GLUT4 and thus entry of glucose into the adipocyte in response to insulin (Gray, S., M. W. Feinberg, et al. (2002). *J Biol Chem* 277(37): 34322-8). Therefore, agonists of KLF15 would be expected to increase glucose entry into the adipocyte and therefore increase lipid storage as the glucose is converted to triglyceride. Conversely, KLF15 antagonists would restrict glucose entry into the adipocytes and reduce energy i.e. fat storage.

Seq ID Nos. 72-73. Nitric Oxide Synthase 3 (NOS3).

Nitric Oxide Synthase has been shown to be increased in the subcutaneous adipose tissue of obese humans as compared to non-obese humans. There is evidence to show that increased production of nitric oxide by nitric oxide synthase, coupled with a decrease in hormone sensitive lipase, may cause decreased lipolysis in obesity. Therefore decreasing NOS3 would be expected to increase lipolysis in adipocytes resulting in reduced obesity.

Seq ID Nos. 89-90. Carbonic Anhydrase III.

Carbonic anhydrase plays a major role in energy metabolism by facilitating transport of CO2 produced by oxidative phosphorylation. Metabolic rate plays an important role in adipose accumulation. If the metabolic rate is low and few calories are burned as energy, any excess calories are stored as lipid in the differentiated adipocyte. Likewise, an increase in metabolism results in increased lipolysis and a reduction of the fat stored in adipocytes. Therefore an increase in carbonic anhydrase would stimulate metabolism and result in an increase in lipolysis/decrease in adipocyte hypertrophy.

Seq ID Nos. 154-155. Lactotransferrin.

Lactotransferrin acts as an inhibitor of carbonic anhydrase (see above). Therefore, inhibition of lactotransferrin would lead to an increase in carbonic anhydrase activity thus stimulating metabolism and result in an increase in lipolysis/decrease in adipocyte hypertrophy.

Seq ID Nos. 1-3. S3-12.

Plasma membrane S3-12 is a plasma membrane protein that is highly induced after adipogenesis (Scherer, P. E., P. E. Bickel, et al. (1998). *Nat Biotechnol* 16(6): 581-6). Lipid is stored in adipocytes in protein coated lipid droplets, and generally these proteins which coat the droplet are members of the perilipin family. S3-12 is a member of this family. Prior to incubation with fatty acids, S3-12 is spread diffusely throughout the adipocyte. Upon incubation with fatty acids, S3-12 begins to coalesce around lipid droplets and by 240 minutes of incubation the S3-12 has become incorporated into perilipin coated droplets. Thus, S3-12 plays a role in lipid storage in the adipocyte (Wolins, N. E., J. R. Skinner, et al. (2003). *J Biol Chem*).

Seq ID Nos. 101-102 Carboxylesterase (p62/CE).

As stated above, GLUT4 plays a major role for entry of glucose into the adipocyte in response to insulin. GLUT4 is sequestered into intracellular sites and is recruited to the cell surface by insulin. P62/CE is found in all insulin sensitive GLUT4 intracellular compartments, and inhibition of p62/CE by an anti-p62/CE antibody abolished insulin recruitment of GLUT4 to the plasma membrane without changing the intracellular GLUT4 distribution. Therefore, p62/CE plays an crucial role for insulin recruitment of GLUT4 to the plasma membrane (Lee, W., J. Ryu, et al. (2000). *J Biol Chem* 275(14): 10041-6).

Seq ID Nos. 12-13. Fsp-27.

FSP27 is an adipocyte specific gene whose expression is regulated by C/EBP as is seen in many genes involved in adipocyte biology. Fsp27 is a member of a family of cell-death-inducing DFF40-like effectors (CIDEs) (Danesch, U., W. Hoeck, et al. (1992). *J Biol Chem* 267(10): 7185-93). The CIDEs have been shown to induce DNA fragmentation which is a hallmark of apoptosis. Thus, FSP27 likely plays a role in the programmed cell death of mature adipocytes. Thus, agonizing FSP27 would be expected to result in an increase in adipocyte apoptosis resulting in a reduced adipose mass and reduced adiposity.

Seq ID Nos. 120-121. Galectin 12.

Galectin-12 has recently been shown to be a predominantly adipocyte-expressed protein which is stimulated by insulin-sensitizing thiazolidinediones and possesses apoptosis-inducing activity (Fasshauer, M., J. Klein, et al. (2002). *Eur J Endocrinol* 147(4): 553-9). Caloric restriction and treatment of obese animals with troglitazone results in an increase in Galectin 12 expression and a decrease in adipocyte size (Hotta, K., T. Funahashi, et al. (2001). *J Biol Chem* 276(36): 34089-97). Induction of Galectin 12 expression is by troglitazone is in parallel with an increase in apoptotic cells, and transfection of 293 cell with Galectin 12 results in an induction of apoptosis. Thus, agonizing Galectin 12 would be expected to result in an increase in adipocyte apoptosis resulting in a reduced adipose mass and reduced adiposity.

Seq ID Nos. 158-159. ABCD2 (ALDR).

ABCD2 is regulated by the cholesterol sensitive sterol regulatory element binding proteins (SREPBs) which are potent transcription factors that are expressed in the differentiating adipocyte and that regulate many genes involved in cholesterol and lipid metabolism. ABCD2 is a peroxisomal protein involved in the beta oxidation of very long chain fatty acids. Peroxisome proliferation is a major event in the differentiation of adipocytes, and interference with peroxisomal function would likely disrupt that process.

Seq ID Nos. 167. Ras Like GTPase TC10.

Expression of this protein is rapidly induced in 3T3-L1 preadipocytes upon addition of induction medium. Antisense molecule to this protein which inhibit expression of TC10 also block the differentiation of 3T3-L1 Preadipocytes into adipocytes in response to differentiation medium. NIH-3T3 cells, which do not usually differentiate into adipocytes, show clear signs of lipid droplet formation and accumulation when TC10 is overexpressed in these cells. The cells also show an increase in expression of PPAR gamma regulated genes in the presence of PPAR gamma ligand. Taken together, these results indicate an essential role for TC10 in the early stages of adipocyte differentiation which may be linked to the PPAR gamma pathway (Nishizuka, M., E. Arimoto, et al. (2003). *J Biol Chem* 278(17): 15279-84).

Seq ID Nos. 173-174. Proteasome Subunit Beta-5.

The proteasome is an essential pathway for the degradation of proteins. The proteasome consists of three "particles": the core particle, which consists of 2 copies of each of 14 different proteins assembled in four stacked rings, and two identical regulatory particles each of which is made of 14 different proteins (distinct from those of the core particle) of which 6 are ATPases. Proteins destined for degradation are conjugated with a short (76 amino acid) protein called ubiquitin. Additional molecules of ubiquitin are then bound to the first ubiquitin molecule forming a chain. The ubiquitin-protein complex binds to ubiquitin recognizing sites on the regulatory particle and the protein is unfolded by the ATPases. The unfolded protein is then transported into the central cavity of the core particle where the protein is then cleaved into peptide chains averaging 8 amino acids long which are then degraded by proteases in the cytosol. The proteasome plays an important role in adipocyte biology. For example, insulin rapidly stimulates the tyrosine kinase activity of the insulin receptor. This leads to phosphorylation of the insulin receptor substrates which then activates phosphoinositol 3 kinase (PI 3-kinase) resulting in increased glucose uptake. It has been demonstrated that interference with proteasome function prolongs sustains the tyrosine phosphorylation of insulin receptor substrate 1 (IRS1) potentiating glucose intake by the adipocyte, leading to a greater accumulation of energy (Rondinone, C. M. and D. Kramer (2002). *Biochem Biophys Res Commun* 296(5): 1257-63.). Also, it has been demonstrated that tumor necrosis factor alpha (TNF alpha) stimulates lipolysis, in part, through inhibitory G proteins (G(i)). Inhibition of proteasome activity blocks the ability of TNF alpha to stimulate lipolysis through the G(i) pathway (Botion, L. M., A. R. Brasier, et al. (2001). *Endocrinology* 142(12): 5069-75). Thus, alteration of proteasome function would affect the ability of adipocytes to take up glucose in response to insulin and hydrolyze lipids in response to TNF-alpha.

Seq ID Nos. 202-203. Resistin-Like Molecule Alpha (RELM Alpha).

RELM alpha belongs to a family of cysteine rich proteins similar to the molecule resistin ("resitant to insulin"). RELM alpha has no effect on the proliferation of undifferentiated 3T3-L1 preadipocytes, and pretreatment of 3T3-L1 preadipocytes has no effect on insulin induced mitogenesis or insulin induced IRS-1 phosphorylation and glucose transport. However, treatment of 3T3-L1 cells with resistin-like alpha inhibits their differentiation into adipocytes (Blagoev, B., I. Kratchmarova, et al. (2002). *J Biol Chem* 277(44): 42011-6). Since resistin like alpha is a secreted protein expressed highly by adipose tissue, it is an important regulator of adipocyte differentiation.

Seq ID Nos. 204-205. Thyroid Hormone Responsive SPOT14.

SPOT14 is a transcription factor which plays a key role in tissue specific regulation of lipid metabolism. SPOT14 was initially found to be responsive to thyroid hormone, but was later found also to be responsive to dietary stimuli, including glucose and polyunsaturated fats, as well as other energy related hormones including insulin and glucagons (Cunningham, B. A., J. T. Moncur, et al. (1998). *Thyroid* 8(9): 815-25). SPOT14 regulates the expression of key metabolic enzymes including those for the synthesis of long chain fatty acids. Inhibition of SPOT14 would lead to decreased lipogenesis in adipocytes and therefore decreased fat accumulation.

Seq ID Nos. 38-39. Matrix Metalloproteinase 9 (MMP9).

The growth of fat requires adipocyte hyperplasia and hypertrophy as well as angiogenesis, and changes of the extracellular matrix components often accompany this cellular remodeling. Also, 3T3-L1 cells change their morphology upon differentiation, from an extended fibroblast-like phenotype to a more rounded one (Croissandeau, G., M. Chretien, et al. (2002). *Biochem J* 364(Pt 3): 739-46), again as a result of extracellular matrix remodeling. MMP9 expression is upregulated both in 3T3-L1 and 3T3F442A preadipocyte upon induction of differentiation. However, inhibition of MMP9 results in a failure of these cells to differentiate in response to the differentiation medium (Lijnen, H. R., E. Maquoi, et al. (2002). *Arterioscler Thromb Vasc Biol* 22(3): 374-9). Therefore, inhibition of MMP9 would reduce adipocyte differentiation, one of the key events in the development of obesity.

Seq ID Nos. 40-41. PTPase.

Obesity is often accompanied by a state of insulin resistance, and this insulin resistance is often reduced in response to weight loss. Reductions in PTPase have been shown to correlate with improved insulin sensitivity in obese subjects in response to weight loss (Ahmad, F., R. V. Considine, et al. (1997). *Metabolism* 46(10): 1140-5). Insulin dependent oxidative inhibition of PTPase plays an important role in permitting the transmission of the signal from insulin to glucose transport (Wu, X., V. E. Hardy, et al. (2003). *Metabolism* 52(6): 705-12). Furthermore, inhibition of PTPase potentiates insulin signal transduction in 3T3-L1 cells (Wu, X., V. E. Hardy, et al. (2003). *Metabolism* 52(6): 705-12).

Seq ID Nos. 10-11. Vap-1.

Vap-1 belongs to a family of semicarbazide sensitive amine oxidases (SSAO). Vap-1 is upregulated in 3T3-L1 and 3T3-F442A preadipocytes upon differentiation, and its enzymatic activity has been shown to upregulate the PI-3 kinase pathway in these cell types as well (Mercier, N., M. Moldes, et al. (2001). *Biochem J* 358(Pt 2): 335-42). This upregulation of the PI-3 kinase pathway mimics the effects of insulin (i.e.

increased glucose uptake and decreased lipolysis) (Zorzano, A., A. Abella, et al. (2003). *Biochim Biophys Acta* 1647(1-2): 3-9). This same effect is also seen in human adipocytes. Furthermore, Vap-1 activity stimulates the acquisition of adipocyte morphology (upregulation of GLUT4, GLUT2, aP2, and glycerol-3-phosphate dehydrogenase) in 3T3-F442A cells. Thus, inhibition of Vap-1 would result in a decrease in fat cell differentiation and therefore the accumulation of fat in adipocytes.

Seq ID Nos. 34-35. Early B-Cell Factor (O/E-1).

O/E-1 is a transcription factor that is expressed in adipose tissue and is upregulated during adipogenesis. Forced expression of O/E-1 in either 3T3-L1 preadipocytes of mouse embryonic fibroblasts increases adipocyte differentiation (Akerblad, P., U. Lind, et al. (2002). *Mol Cell Biol* 22(22): 8015-25). Furthermore, constitutive expression of O/E-1 in uncommitted 3T3NIH fibroblasts, which do not normally differentiate into adipocytes leads to the initiation of differentiation to adipocytes. Repression of O/E-1 suppresses 3T3-L1 differentiation. Thus, O/E-1 is an important regulator of adipocyte differentiation and inhibition of O/E-1 would lead to a decrease in differentiated adipocytes and therefore a decrease in adipocyte hypertrophy.

Seq ID Nos. 64-65. Sonic Hedgehog Homolog.

The hedgehog family of proteins regulate varying aspects of tissue development. Sonic Hedgehog (Shh) abolishes the differentiation of C3H10T1/2 cells (Spinella-Jaegle, S., G. Rawadi, et al. (2001). *J Cell Sci* 114(Pt 11): 2085-94). Short treatment of these cells with Shh dramatically reduces the adipogenic transcription factors C/EBP alpha and PPAR gamma. Therefore, inhibition of Shh would result in a decrease in adipocyte differentiation and thus a decrease in adipocyte hypertrophy.

G-Proteins/G-Protein Coupled Receptors/Signal Transduction

It has been well established that many medically significant biological processes are mediated by proteins participating in signal transduction pathways that involve guanylnucleotide-binding proteins (G-proteins) and/or second messengers, e.g., cAMP. Some examples of proteins that participate in G-protein signaling pathways include the G-protein coupled receptors (GPCRs), such as those adregenergic and dopaminergic receptors, G-proteins themselves, effector proteins, e.g., phospholipase C, adenyl cyclase, guanylyl cyclase, and phosphodiesterase, and actuator proteins such as protein kinase A and protein kinase C.

An example of this type of G-protein signal transduction would be binding of a hormone to a cell surface receptor activating the enzyme adenyl cyclase. The hormone binds to its cell surface receptor which in turn binds to a heterotrimeric G-protein in the plasma membrane consisting of an alpha, a beta, and a gamma subunit. The binding of the hormone receptor to the G-protein causes the G-protein to exchange a bound molecule of GDP with a molecule of GTP. The GTP bound form then interacts with and activates adenyl cyclase which converts ATP to cyclic AMP (cAMP) which acts as a second messenger to deliver the signal. The G-protein is also a slow GTPase, and slowly converts the bound GTP to GDP, thus returning the G-protein to its inactive form. In the absence of hormone, the vast majority of G-proteins are bound to GDP and are thus inactive. A single hormone bound receptor is capable of activating many G-protein complexes, thus amplifying the signal. Thus the G-protein acts in two ways: it transmits and amplifies the signal from the receptor to the effector, and determines the duration of the signal by the rate at which its GTPase activity hydrolyzes GTP to GDP and inactivates itself.

G-protein coupled receptors can be intracellularly coupled by heterotrimeric G-proteins to various intracellular enzymes, ion channels and transporters. Different G-protein .alpha.-subunits preferentially stimulate or inhibit particular effectors to modulate various biological functions in a cell. Phosphorylation of cytoplasmic residues of G-protein coupled receptors have been identified as an important mechanism for the regulation of G-protein coupling of some G-protein coupled receptors. G-protein coupled receptors are found in numerous sites within a mammalian host. Genes found by our method that participate in G-protein signal transduction include:

Seq ID Nos.

143-144 CDC42

234-235 GPR18

49-50 G-protein inhibitory alpha subunit 1

55-56 Guanylate Nucleotide Binding Protein 2

59,83 G-protein alpha 2 subunit 163-164 Ras p21 protein activator 2 (Rasa2)

257-258 GPR127

The process of signal transduction by which signals from outside of the cell are transmitted to the inside of the cell are central to many biological processes. For example, the signal for insulin to upregulate expression of the insulin sensitive glucose transporters is key in the etiology of obesity and diabetes. Other signal transduction molecules that were found using our method include:

Seq ID Nos.

4-9 Neuronatin 136-137 Leukotriene C4 Synthase 185-186 Copine II 208-209 Syntaxin 1B like molecule Inflammation There is evidence to indicate that obesity may be a chronic, low-grade inflammatory response (Das, U. N., *Nutritition*, 2001; 17(11-12):956-966). Other examples of chronic inflammatory diseases are arthritis, atherosclerosis, etc. Obese children and adults have elevated markers of inflammatory response including C-reactive protein, interleukin-6, and tumor necrosis factor alpha (TNF alpha). In particular, TNF alpha is well known to have a profound stimulatory effect on lipolysis in adipocytes. Inflammation factors which affect obesity found using our method are:

Seq ID Nos.

78-79 chemokine (C—C) receptor 2

14 MRP14

17-18 CD1d1

147 Isg12

152-153 Decay accelerating factor 1 (DAF1)

29 Scya6

36-37 Scya 5 (RANTES)

21-22 CD53 antigen 57-58 Proteinase 3

225-226 D-6 beta chemokine receptor 80-81 Interferon regulatory factor 4

Apoptosis

The term apoptosis was coined in a now-classic paper by Kerr, Wyllie, and Currie (Brit J. Cancer 26:239) in 1972 as a means of distinguishing a morphologically distinctive form of cell death which was associated with normal physiology. Apoptosis was distinguished from necrosis, which was associated with acute injury to cells. Apoptosis is characterized by nuclear chromatin condensation, cytoplasmic shrinking, dilated endoplasmic reticulum, and membrane blebbing. Mitochondria remain unchanged morphologically.

Apoptotic death can be triggered by a wide variety of stimuli, and not all cells necessarily will die in response to the same stimulus. Among the more studied death stimuli is DNA damage (by irradiation or drugs used for cancer chemotherapy), which in many cells leads to apoptotic death via a pathway dependent on p53. Some hormones such as corticosteroids lead to death in particular cells (e.g., thymocytes), although other cell types may be stimulated. Some cells types express Fas, a surface protein which initiates an intracellular death signal in response to crosslinking. In other cases cells appear to have a default death pathway which must be actively blocked by a survival factor in order to allow cell survival.

Apoptosis in adipocytes (lipoapoptosis) is an important regulator of fat mass. If lipoapoptosis is defective, then an overaccumulation of fat cells will occur and will contribute to the development and maintenance of obesity. Factors affecting lipoapoptosis identified using our method include:

Seq ID Nos.

80-81 Interferon regulatory factor 4

12-13 Fsp27

120-121 Galectin 12

Angiogenesis

Angiogenesis is the process by which growing tissues generate new blood vessels (vascularization) in order to ensure an adequate blood supply. Prevention of angiogenesis can be used to treat human diseases. For example, certain types of cancer may be treated by inhibiting vascular endothelial growth factor (VEGF) so that the tumor cannot grow new blood vessels and thus cannot expand. Angiogenesis must also occur in growing adipose tissue. Leptin normally inhibits angiogenesis (Yamagishi, et al., 2003, *Microvasc Res*, 65(3): 186-190) although this mechanism fails in obesity. Therefore, genes that affect the ability of adipose tissue to vascularize as it expands would be useful for the treatment of obesity. The genes involved in angiogenesis that we have found using our method includes:

Seq ID Nos.

15-16 Peg 1/MEST 19-20 Synuclein gamma 38-39 MMP9

Differentiation

Differentiation of preadipocytes into adipocytes is one of the first events in obesity. In a response to excess calorie intake, preadipocytes multiply (hyperplastic obesity) and differentiate. The cells enter a program in which they uptake glucose from the plasma and convert it into fat, primarily triglyceride. This fat is store in the cytoplasm as a lipid droplet. As the droplet accumulates lipid, the adipocytes swell until they are no longer able to increase in size (hypertrophic obesity). Thus, interference with the ability of preadipocytes to differentiate would aid in the treatment of obesity. Genes involved in adipocyte differention identified using our method include:

Seq ID Nos.

158-159 ABCD2

167 GTPase TC10

202-203 Resistin like molecule alpha 206-207 cyclin M-3

40-41 CD45

34-35 Early B Cell Factor (O/E-1)

60-61 Colony Stimulating Factor 2 Receptor (CSF2 receptor)

64-65 Sonic Hedgehog homolog 165-166 Ar14

212-213 limb-bud and heart gene (LBH)

The nucleic acid sequences not specifically referred to above but disclosed herein are also relevant in adipogenesis by virtue of being identified by the method described.

Polynucleotides

Included in the present invention are polynucleotides encoding polypeptides which have at least 91% identity, preferably at least 92% identity, more preferably at least 993% identity, yet more preferably at least 94% identity, even more preferably at least 96-99% identity, to the amino acid sequence of any of the adipocyte specific peptides over the entire length of the recited amino acid sequence.

When the polynucleotides of the invention are used for the recombinant production of the nucleic acid, the polynucleotide may include the coding sequence for the mature polypeptide or a fragment thereof, by itself; the coding sequence for the mature polypeptide or fragment in reading frame with other coding sequences, such as those encoding a leader or secretory sequence, a pre-, or pro- or prepro-protein sequence, or other fusion peptide portions. For example, a marker sequence which facilitates purification of the fused polypeptide can be encoded. The polynucleotide may also contain non-coding 5' and 3' sequences, such as transcribed, non-translated sequences, splicing and polyadenylation signals, ribosome binding sites and sequences that stabilize mRNA.

Thus, this invention provides oligonucleotides (sense or antisense strands of DNA or RNA) having sequences capable of hybridizing with at least one sequence of a nucleic acid molecule encoding the protein of the present invention. Such oligonucleotides are useful as probes for detecting genes identified by the adipocyte specific sequences or their transcripts. In one preferred embodiment, oligonucleotides for use as probes or primers are based on rationally-selected amino acid sequences chosen from the sequence expressed by the adipocyte specific nucleotide sequences. In preferred embodiments, the amino acid sequence information is used to make degenerate oligonucleotide sequences as is commonly done by those skilled in the art. In other preferred embodiments the degenerate oligonucleotides are used to screen cDNA libraries from human and mouse.

The polynucleotides of the present invention may be prepared by two general methods: (1) they may be synthesized from appropriate nucleotide triphosphates, or (2) they may be isolated from biological sources. Both methods utilize protocols well known in the art. The availability of nucleotide sequence information, such as the cDNA from this disclosure, enables preparation of an isolated nucleic acid molecule of the invention by oligonucleotide synthesis. Synthetic oligonucleotides may be prepared by the phosphoramadite method employed in the Applied Biosystems 38A DNA Synthesizer or similar devices. The resultant construct may be purified according to methods known in the art, such as high performance liquid chromatography (HPLC). Long, double-stranded polynucleotides, must be synthesized in stages, due to the size limitations inherent in current oligonucleotide synthetic methods. Thus, for example, a long double-stranded molecule may be synthesized as several smaller segments of appropriate complementarity. Complementary segments thus produced may be annealed such that each segment possesses appropriate cohesive termini for attachment of an adjacent segment. Adjacent segments may be ligated by annealing cohesive termini in the presence of DNA ligase to construct an entire long double-stranded molecule. A synthetic DNA molecule so constructed may then be cloned and amplified in an appropriate vector. Relevant genes also may be isolated from appropriate biological sources using methods known in the art. In the exemplary embodiments of the invention, the genes may be isolated from genomic libraries of human or mouse. In alternative embodiments, cDNA clones of the genes may be isolated, such as have been isolated from human, or murine cDNA libraries. A preferred means for isolating genes is PCR amplification using genomic or cDNA templates and gene specific primers. Genomic and cDNA libraries are commercially available, and can also be made by procedures well known in the art. In positions of degeneracy where more than one nucleic acid residue could be used to encode the appropriate amino acid residue, all the appropriate nucleic acid residues may be incorporated to create a mixed oligonucleotide population, or a neutral base such as inosine may be used. The strategy of oligonucleotide design is well known in the art.

Alternatively, PCR primers may be designed by the above method to match the coding sequences of a human or murine protein and these primers used to amplify the native nucleic acids from isolated cDNA or genomic DNA.

In accordance with the present invention, nucleic acids having the appropriate level sequence homology with a part or with all of the coding region, may be identified by using hybridization and washing conditions of appropriate stringency. For example, hybridizations may be performed, according to the method of Sambrook et al., using a hybridization solution comprising: 1.0% SDS, up to 50% formamide, 5×SSC (150 mM NaCl, 15 mM trisodium citrate), 0.05% sodium pyrophosphate (pH 7.6), 5×Denhardt's solution, and 100 microgram/ml denatured, sheared salmon sperm DNA. Hybridization is carried out at 37-42° C. for at least six hours. Following hybridization, filters are washed as follows: (1) 5 minutes at room temperature in 2×SSC and 1% SDS; (2) 15 minutes at room temperature in 2×SSC and 0.1% SDS; (3) 30 minutes to 1 hour at 37° C. in 2×SSC and 0.1% SDS; (4) 2 hours at 45-55° C. in 2×SSC and 0.1% SDS, changing the solution every 30 minutes.

One common formula for calculating the stringency conditions required to achieve hybridization between nucleic acid molecules of a specified percent identity is set forth by (Sambrook et al., 1989, supra):

$$T_m = 81.5° C. + 16.6 \text{ Log } [Na^+] + 0.41(\% G+C) - 0.63 (\% \text{ formamide}) - 600/\#bp \text{ in duplex}$$

As an illustration of the above formula, using $[Na^+]=[0.368]$ and 50% formamide, with GC content of 42% and an average probe size of 200 bases, the $T_m$ is 57° C. The $T_m$ of a DNA duplex decreases by 1-1.5° C. with every 1% decrease in homology. Thus, targets with greater than about 75% sequence identity would be observed using a hybridization temperature of 42° C.

The stringency of the hybridization and wash depend primarily on the salt concentration and temperature of the solutions. In general, to maximize the rate of annealing of the probe with its target, the hybridization is usually carried out at salt and temperature conditions that are 20-25° C. below the calculated $T_m$ of the of the hybrid. Wash conditions should be as stringent as possible for the degree of identity of the probe for the target. In general, wash conditions are selected to be approximately 12-20° C. below the $T_m$ of the hybrid. In regards to the nucleic acids of the current invention, a moderate stringency hybridization is defined as hybridization in 6×SSC, 5×Denhardt's solution, 0.5% SDS and 100 µg/ml denatured salmon sperm DNA at 42° C., and wash in 2×SSC and 0.5% SDS at 55° C. for 15 minutes. A high stringency hybridization is defined as hybridization in 6×SSC, 5×Denhardt's solution, 0.5% SDS and 100 µg/ml denatured salmon sperm DNA at 42° C., and wash in 1×SSC and 0.5% SDS at 65° C. for 15 minutes. A very high stringency hybridization is defined as hybridization in 6×SSC, 5×Denhardt's solution, 0.5% SDS and 100 µg/ml denatured salmon sperm DNA at 42° C., and wash in 0.1×SSC and 0.5% SDS at 65° C. for 15 minutes.

Nucleic acids of the present invention may be maintained as DNA in any convenient cloning vector. In a preferred embodiment, clones are maintained in plasmid cloning/expression vector, such as pBluescript (Stratagene, La Jolla, Calif.), which is propagated in a suitable E. coli host cell.

The adipocyte specific polynucleotides may be used for a variety of purposes in accordance with the present invention. DNA, RNA, or fragments thereof may be used as probes to detect the presence of and/or expression of adipocyte specific genes. Methods in which the polynucleotides may be utilized as probes for such assays include, but are not limited to: (1) in situ hybridization; (2) Southern hybridization (3) northern hybridization; and (4) assorted amplification reactions such as polymerase chain reaction (PCR).

The polynucleotides may also be utilized as probes to identify related genes from other species. As is well known in the art, hybridization stringencies may be adjusted to allow hybridization of nucleic acid probes with complementary sequences of varying degrees of homology.

As described above, adipocyte specific nucleic acids may be used to produce large quantities of substantially pure proteins, or selected portions thereof.

The nucleic acids of the present invention can be used to identify and isolate other members of the growth regulatory pathway(s) in which the protein is involved. A yeast two-hybrid system can be used to identify proteins that physically interact with the identified adipocyte specific protein, as well as isolate their nucleic acids. In this system, the coding sequence of the protein of interest is operably linked to the coding sequence of half of an activator protein. This construct is used to transform a yeast cell library which has been transformed with DNA constructs that contain the coding sequence for the other half of the activator protein operably linked to a random coding sequence from the organism of interest. When the protein made by the random coding sequence from the library interacts with the protein of interest, the two halves of the activator protein are physically associated and form a functional unit that activates the reporter gene. In accordance with the present invention, all or part of the human, mouse, bovine or rat coding sequence may be operably linked to the coding sequence of the first half of the activator, and the library of random coding sequences may be constructed with cDNA from human, mouse, bovine or rat and operably linked to the coding sequence of the second half of the activator protein. Several activator protein/reporter genes are customarily used in the yeast two hybrid system, the Gal4/LacZ system (see Clark et al., 1998 PNAS 95:5401-5406), among others.

The nucleotide sequences of the present invention are also valuable for chromosomal localization. The sequence is specifically targeted to, and can hybridize with, a particular location on an individual eukaryotic chromosome. The mapping of relevant sequences to chromosomes according to the present invention is an important first step in correlating those sequences with gene associated disease. Once a sequence has been mapped to a precise chromosomal location, the physical position of the sequence on the chromosome can be correlated with genetic map data. The relationship between genes and diseases that have been mapped to the same chromosomal region are then identified through linkage analysis (coinheritance of physically adjacent genes).

In the present invention, mapping of the adipocyte specific nucleic acid sequences to chromosomes would be an especially beneficial contribution to the human obesity gene map. The human obesity study has attempted to relate DNA sequence variation in specific genes to obesity phenotypes. To date, 44 loci have linked to obesity indicators in genomic scans and other linkage study designs. The number of genes, markers, and chromosomal regions that have been associated or linked with human obesity phenotypes continues to increase and is now well above 200. (The Human Obesity Gene Map: The 1999 Update, Obesity Research Vol 8 NO: 1 January 2000.)

The polynucleotides of the present invention can be used to identify and further isolate other members of the adipose accumulation pathways specific to adipose tissue. Identification of proteins that interact with the protein encoded by identified genes will introduce new agents to influence the pathways involved in adipose accumulation.

Polypeptides

In another aspect, the present invention relates to human adipocyte specific polypeptides (or proteins). The present invention further provides for a polypeptide which comprises an amino acid sequence which has at least 90% identity, more preferably at least 91% identity, yet more preferably at least 92% identity, yet more preferably at least 95% identity, most preferably at least 96-99% identity, to that of the entire length of any one of the sequences identified herein.

In one aspect of the invention, the polypeptides may be produced in large amounts in order to aid in the identification of ligands or substrates that bind to, or modulate the action of the polypeptides. The action of purified protein may be characterized by determination of its three dimensional crystal structure leading to elucidation of the molecular binding sites further aiding studies in computer modeling of intermolecular interactions within substrate binding sites. Determination of specific sites of activity within the protein structure aids in the design of pharmaceuticals to directly interact with the protein to modulate its activity.

In another aspect of the invention, characterization of the protein aids in elucidation of the protein pathways involved in adipose accumulation because the development of agents to minimize protein activity may disrupt associated protein pathways and promote discovery of associated proteins. Characterization assays may be developed with the aid of labeled in vitro protein-protein binding assays, electrophoretic mobility shift assays, immunoassays for protein binding. In addition, chromophoric substitution within the protein binding site may be used in fluorescence studies measuring chromophoric quenching.

The present data indicates that the identified genes are associated with adipose accumulation. The identified adipocyte specific polypeptides may be in the form of the "mature" protein or may be a part of a larger protein such as a fusion protein. It is often advantageous to include an additional amino acid sequence which contains secretory or leader sequences, pro-sequences, sequences which aid in purification such as multiple histidine residues, or an additional sequence for stability during recombinant production.

Fragments of the polypeptides are also included in the invention. A fragment is a polypeptide having an amino acid sequence that entirely is the same as part, but not all, of the amino acid sequence of the polypeptides. Preferred fragments include, for example, truncation polypeptides having the amino acid sequence of the polypeptides, except for deletion of a continuous series of residues that includes the amino terminus, or a continuous series of residues that includes the carboxyl terminus or deletion of two continuous series of residues, one including the amino terminus and one including the carboxyl terminus. Also preferred are fragments characterized by structural or functional attributes such as fragments that comprise alpha-helix and alpha-helix forming regions, beta-sheet and beta-sheet-forming regions, turn and turn-forming regions, coil and coil-forming regions, hydrophilic regions, hydrophobic regions, alpha amphipathic regions, beta amphipathic regions, flexible regions, surface-forming regions, substrate binding regions, and high antigenic index regions. Other preferred fragments are biologically active fragments. Biologically active fragments are those that mediate the peptides activity, including those with a similar activity or an improved activity, or with a decreased undesirable activity. Also included are those that are antigenic or immunogenic in an animal, especially in a human. Preferably, all of these polypeptide fragments retain the biological activity of the identified peptide, including any antigenic activity. Variants of the defined sequence and fragments also form part of the present invention. Preferred variants are those that vary from the referents by conservative amino acid substitutions.

The polypeptides of the invention can be prepared in any suitable manner. If produced in situ, the polypeptides may be purified from appropriate sources, e.g., cells from human or mouse.

Alternatively, the availability of nucleic acid molecules encoding the polypeptides enables production of the proteins using in vitro expression methods known in the art. For example, a cDNA or gene may be cloned into an appropriate in vitro transcription vector, for in vitro transcription, followed by cell-free translation in a suitable cell-free translation system. In vitro transcription and translation systems are commercially available, e.g., from Promega Biotech, Madison, Wis., or Invitrogen, Carlsbad, Calif. While in vitro transcription and translation is not the method of choice for preparing large quantities of the protein, it is ideal for preparing small amounts of native or mutant proteins for research purposes, particularly since it allows the incorporation of radioactive nucleotides.

According to a preferred embodiment, larger quantities of the encoded polypeptide may be produced by expression in a suitable prokaryotic or eukaryotic system. For example, part or all of a DNA molecule, such as the coding portion of an identified sequence may be inserted into a plasmid vector adapted for expression in a bacterial cell (such as *E. coli*) or a yeast cell (such as *Saccharomyces cerevisiae*), or into a baculovirus vector for expression in an insect cell. Such vectors comprise the regulatory elements necessary for expression of the DNA in the host cell, positioned in such a manner as to permit expression of the DNA into the host cell. Such regulatory elements required for expression include promoter sequences, transcription initiation sequences and, optionally, enhancer sequences.

Secretion signals may be used to facilitate purification of the resulting protein. The coding sequence for the secretion peptide is operably linked to the 5' end of the coding sequence for the protein, and this hybrid nucleic acid molecule is inserted into a plasmid adapted to express the protein in the host cell of choice. Plasmids specifically designed to express and secrete foreign proteins are available from commercial sources. For example, if expression and secretion is desired in *E. coli*, commonly used plasmids include pTrcPPA (Pharmacia); pPROK-C and pKK233-2 (Clontech); and pNH8a, pNH16a, pcDNAII and pAX (Stratagene), among others.

The proteins produced by in vitro transcription and translation or by gene expression in a recombinant prokaryotic or eukaryotic system may be purified according to methods known in the art. Recombinant proteins can be purified by affinity separation, such as by immunological interaction with antibodies that bind specifically to the recombinant protein or fusion proteins such as His tags, as described below. Such methods are commonly used by skilled practitioners.

As mentioned, the proteins can be produced and fused to a "tag" protein in order to facilitate subsequent purification. These fusion proteins are produced by operably-linking the nucleic acid coding sequence of the "tag" protein to the coding sequence of the protein of interest, and expressing the fused protein by standard methods. Systems are commercially available that comprise a plasmid containing an expression cassette with the "tag" protein coding sequence and a polylinker into which a coding sequence of interest can be operably ligated. These fusion protein systems further provide chromatography matrices or beads which specifically bind the "tag" protein thereby facilitating the fusion protein purification. These fusion protein systems often have the recognition sequence of a protease at or near the junction of the "tag" protein and the protein of interest so that the "tag" protein can be removed if desired. Fusion protein systems include, but are not limited to, the His-6-tag system (Quiagen) and the glutathione-S-transferase system (Pharmacia).

The proteins of the invention, prepared by one of the aforementioned methods, may be analyzed according to standard procedures. For example, the protein may be subjected to amino acid composition, amino acid sequence, or protein concentration analysis according to known methods.

Using appropriate amino acid sequence information, synthetic proteins of the present invention may be prepared by various synthetic methods of peptide synthesis via condensation of one or more amino acid residues, in accordance with conventional peptide synthesis methods. Preferably, peptides are synthesized according to standard solid-phase methodologies, such as may be performed on an Applied Biosystems Model 430A peptide synthesizer (Applied Biosystems, Foster City, Calif.), according to manufacturer's instructions. other methods of synthesizing peptides or peptidomimetics, either by solid phase methodologies or in liquid phase, are well known to those skilled in the art.

The protein can be used as a label in many in vitro applications currently used. Purified proteins can be covalently linked to other proteins by methods well known in the art, and used as a marker protein. The purified protein can be covalently linked to a protein of interest in order to determine localization. In particularly preferred embodiments, a linker of 4 to 20 amino acids is used to separate the protein from the desired protein. This application may be used in living cells by micro-injecting the linked proteins. The protein may also be linked to antibodies and used thus for localization in fixed and sectioned cells. The protein may be linked to purified cellular proteins and used to identify binding proteins and nucleic acids in assays in vitro, using methods well known in the art.

The proteins of the present invention can be used to identify each of their binding partners in coimmunoprecipitation (co-IP). In these assays, the first protein of interest is allowed to form a physical interaction with the unknown binding protein(s), often in a heterologous solution of proteins. The complex of proteins is then isolated, and the nature of the protein complex is determined. This procedure is greatly facilitated by a simple method for isolating the protein. For example, immunologically-specific antibodies can be used to precipitate the proteins, or the proteins can be bound to beads that can be easily purified. Such beads can be magnetized, or simply dense enough to be separated form the non-associated protein by centrifugation.

Vectors, Host Cells, and Expression

The present invention also relates to vectors which comprise a polynucleotide or polynucleotides of the present invention, and host cells which are genetically engineered with vectors of the invention and to the production of polypeptides of the invention by recombinant techniques. Cell-free translation systems can also be employed to produce such proteins using RNAs derived from the DNA constructs of the present invention.

For recombinant production, host cells can be genetically engineered to incorporate expression systems or portions thereof for polynucleotides of the present invention. Introduction of polynucleotides into host cells can be effected by methods described in many standard laboratory manuals, such as Davis et al., BASIC METHODS IN MOLECULAR BIOLOGY (1986) and Sambrook et al., MOLECULAR CLONING: A LABORATORY MANUAL, 2nd Ed., Cold Spring Harbor Laboratory Press, Cold Spring Harbor, N.Y. (1989) such as calcium phosphate transfection, DEAE-dextran mediated transfection, transvection, microinjection, cationic lipid-mediated transfection, electroporation, transduction, scrape loading, ballistic introduction or infection.

Representative examples of appropriate hosts include bacterial cells, such as streptococci, staphylococci, *E. coli, Streptomyces* and *Bacillus subtilis* cells; fungal cells, such as yeast cells and *Aspergillus* cells; insect cells such as *Drosophila* SL2 and *Spodoptera*. Sf9 cells; mammalian cells such as CHO, COS, HeLa, C127, 3T3, BHK, HEK 293 and Bowes melanoma cells; and plant cells. The selection of an appropriate host is deemed to be within the scope of those skilled in the art from the teachings herein.

More particularly, the present invention also includes recombinant constructs comprising the cDNA sequence. The constructs comprise a vector, such as a plasmid or viral vector, into which the clone has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available. The following vectors are provided by way of example; Bacterial: pQE70, pQE60, pQE-9 (Qiagen), pBS, pD10, phagescript, ☐X174, pBluescript SK, pbsks, pNH8A, pNH16a, pNH18A, pNH46A (Stratagene); ptrc99a, pKK223-3, pKK233-3, pDR540, pRIT5 (Pharmacia); Eukaryotic: pWLNEO, pSV2CAT, pOG44, pXT1, pSG (Stratagene) pSVK3, pBPV, pMSG, pSVL (Pharmacia). However, any other plasmid or vector may be used as long as they are replicable and viable in the host. In addition, a complete mammalian transcription unit and a selectable marker can be inserted into a prokaryotic plasmid. The resulting vector is then amplified in bacteria before being transfected into cultured mammalian cells. Examples of vectors of this type include pTK2, pHyg and pRSVneo.

A great variety of expression systems can be used. Such systems include, among others, chromosomal, episomal and virus-derived systems, e.g., vectors derived from bacterial plasmids, from bacteriophage, from transposons, from yeast episomes, from insertion elements, from yeast chromosomal elements, from viruses such as baculoviruses, papova viruses, such as SV40, vaccinia viruses, adenoviruses, fowl pox viruses, pseudorabies viruses and retroviruses, and vectors derived from combinations thereof, such as those derived from plasmid and bacteriophage genetic elements, such as cosmids and phagemids. The expression systems may contain control regions that regulate as well as engender expression. Generally, any system or vector suitable to maintain, propagate or express polynucleotides to produce a polypeptide in a host may be used. The appropriate nucleotide sequence may be inserted into an expression system by any of a variety of well-known and routine techniques, such as, for example, those set forth in Sambrook et al., *MOLECULAR CLONING, A LABORATORY MANUAL* (supra).

Promoter regions can be selected from any desired gene using CAT (chloramphenicol acetyl transferase) vectors or other vectors with selectable markers. Two appropriate vectors are pKK232-8 and pCM7. Particular named bacterial promoters include lacI, lacZ, T3, T7, gpt, lambda PR, PL and trp. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art.

For secretion of the translated protein into the lumen of the endoplasmic reticulum, into the periplasmic space or into the extracellular environment, appropriate secretion signals may be incorporated into the desired polypeptide. These signals may be endogenous to the polypeptide or they may be heterologous signals.

If a polypeptide is to be expressed for use in screening assays, generally, it is preferred that the polypeptide be produced at the surface of the cell. In this event, the cells may be harvested prior to use in the screening assay. If the polypeptide is secreted into the medium, the medium can be recovered in order to recover and purify the polypeptide; if produced intracellularly, the cells must first be lysed before the polypeptide is recovered.

Polypeptides can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography (HPLC) or fast protein liquid chromatography (FPLC) is employed for purification. Well known techniques for refolding proteins may be employed to regenerate active conformation when the polypeptide is denatured during isolation and or purification.

Antibodies

The present invention also provides antibodies capable of immunospecifically binding to polypeptides of the invention. Polyclonal or monoclonal antibodies directed towards the polypeptide encoded by any one of the identified adipocyte specific sequences may be prepared according to standard methods. Monoclonal antibodies may be prepared according to general hybridoma methods of Kohler and Milstein, *Nature* (1975) 256:495-497), the trioma technique, the human B-cell hybridoma technique (Kozbor et al., *Immunology Today* (1983) 4:72) and the EBV-hybridoma technique (Cole et al., MONOCLONAL ANTIBODIES AND CANCER THERAPY, pp. 77-96, Alan R. Liss, Inc., 1985). In a preferred embodiment, antibodies are prepared, which react immunospecifically with various epitopes of the encoded polypeptides. These above-described antibodies may be employed to isolate or to identify clones expressing the polypeptide or to purify the polypeptides by affinity chromatography.

Antibodies that are immunologically specific to the proteins, or specific epitopes thereof, may be utilized in affinity chromatography to isolate the proteins, to quantify the protein utilizing techniques such as western blotting and ELISA, or to immuno-precipitate the proteins from a sample containing a mixture of proteins and other biological materials. The immuno-precipitation of a protein is particularly advantageous when utilized to isolate binding partners of the protein, as described above.

Monoclonal antibodies or other genetically engineered antibodies with specificity for the peptide of the invention could be used as therapeutic agents. The antibodies should then be humanized to reduce the immunogenicity. Humanization is accomplished by linking the complementarity determining region (CDR) from the original murine antibody to the constant regions of a human antibody. Various methods may be employed to ensure the specificity and avidity of the linked antibody (Queen, C., et al., Proc. Natl. Acad. Sci. USA, 86, 10029, 1989 and Reichmann, et al., Nature, 332, 323, 1988).

Antibodies to the peptide of the invention may be used for diagnostic assays, for determination of circulating levels the peptide, and as antagonists to block peptide activity in vitro and in vivo (see, for example, Immobilized. Affinity Ligand Techniques, Hermanson, et al., eds., Academic Press, San Diego, Calif., 1992, pp 195-202).

The invention also provides a pharmaceutical composition, comprising one or more vectors which comprise DNA constructs comprising any of the nucleic acid sequences of SEQ ID NO: 1 to 277.

In another embodiment, the invention provides a pharmaceutical composition comprising one or more peptides encoded by any of the sequences SEQ ID NO: 1 to 277.

In yet another embodiment, the invention provides for a pharmaceutical composition comprising an agonist to any of the peptides encoded by any of the sequences SEQ ID NO: 1 to 277.

In still another embodiment, the invention provides for a pharmaceutical composition comprising an antagonist to any of the peptides encoded by any of the sequences SEQ ID NO: 1 to 277.

Pharmaceutical compositions comprising a peptide or DNA construct of the invention may be formulated by any of the established methods for formulating pharmaceutical compositions (see, for example, Gennaro, A. R., Remington's Pharmaceutical Sciences, 18$^{th}$ edition, 1985, Pharmaceutical Press). The pharmaceutical composition may be in a form suitable for systemic injection or infusion and may, as such, be formulated with a suitable liquid carrier such as sterile water, isotonic saline or isotonic glucose solution. The pharmaceutical composition may be sterilized by conventional sterilization techniques well known in the art, such as autoclaving, irradiation, or filter sterilization. The resulting sterile aqueous solutions may be packaged for use or filtered under aseptic conditions and lyophilized in which circumstance the lyophilized material is combined with an appropriate aqueous solution prior to administration. The composition may contain pharmaceutically acceptable auxiliary substances as required to approximate physiological conditions, such as buffering agents, tonicity adjusting agents, etc., for instance sodium acetate, sodium chloride, potassium chloride, calcium chloride, etc. The pharmaceutical composition may also be adapted for other routes of administration, such as nasal, transdermal, pulmonal, or rectal. The pharmaceutically acceptable carrier or diluent in the composition may be any conventional solid carrier. Examples of solid carriers are lactose, terra alba, sucrose, talc, gelatin, agar, pectin, acacia magnesium stearate, and stearic acid. Similarly, the carrier or diluent may include any sustained release material known in the art, such as glyceryl monostearate or glyceryl distearate alone or mixed with a wax. In another embodiment, the invention provides a pharmaceutical composition in the form of a sustained release formulation. The sustained release formulation may include microcapsules or microparticles containing the polypeptide encapsulated or dispersed in a pharmaceutically suitable biodegradable polymer such as polylactic acid, polyglycolic acid, or a lactic acid/polyglycolic acid copolymer.

For nasal administration, the preparation may contain the peptide of the invention dissolved or suspended in a liquid carrier, in particular an aqueous carrier, for aerosol administration. The carrier may contain additives such as solubilizing agents, for example propylene glycol, surfactants, absorption enhancers such as phosphatidyl choline, or cyclodextrin, or preservatives such as parabenes.

In general, the compounds of the present invention are dispensed in unit dosage form comprising 0.5 mg-50 mg of the peptide (assuming a 70 kg patient) together with a pharmaceutically acceptable carrier per unit dosage. The peptide is considered to be advantageous to use in weight reduction programs, such as for the treatment of diseases or disorders of excess, morbid overweight. Such diseases include obesity and non-insulin dependent diabetes mellitus (NIDDM; Type II diabetes). The dosage of the peptide administered to a patient will vary with the type and severity of the condition being treated, but is generally in the range of from approximately 0.01 mg/kg to about 5 mg/kg body weight.

The peptide or the DNA construct is considered to be advantageous in the treatment of diseases or conditions resulting from obesity including, for example, hypertension, atherosclerosis, coronary artery disease, cerebrovascular disease, insulin resistance, etc.

The peptide or the DNA construct may be administered in combination with food.

In the pharmaceutical composition of the invention, the peptide may be combined with an appetite suppressing or satiety inducing agent. An example of such an agent is GLP-1 which has been shown to be efficaceous in appetite suppression (Turton, M. D., et al., Nature 379, 4 January 1996, p. 69-72).

Animal model systems that elucidate the physiological and behavioral role of the peptide or the peptide receptor of the invention may be produced by creating transgenic animals in which the activity of the peptide or the peptide receptor is either increased or decreased, or the amino acid sequence of the expressed peptide or peptide receptor is altered, by a variety of techniques well known in the art. (see, for example, Molecular Biology and Biotechnology ($3^{rd}$ ed.), Walker and Gingold eds., The Royal Society of Chemistry, 1993). Examples of the techniques include, but are not limited to: 1) insertion of normal or mutant versions of DNA encoding a peptide or a peptide receptor by microinjection, electroporation, retroviral transfection or other means well known to those skilled in the art, into appropriate fertilized embryos in order to produce a transgenic animal; or 2) Homologous recombination of mutant or normal, human or animal versions of these genes with the native locus in transgenic animals to alter the regulation of expression or the structure of these peptide or peptide receptor sequences. The technique of using homologous recombination to create so-called "knockout" mice is well known and practiced in the art.

In another embodiment, the polypeptide of the present invention may be used in a screening process to identify compounds that activate ("agonists") or deactivate ("antagonists"; "inhibitors") the polypeptide of the invention. The agonist and antagonist may be isolated from, for example, cells, cell free preparations, combinatorial libraries, and natural product mixtures. They may be natural or modified substrate, ligands, enzymes, receptors, kinases, phosphatases, etc. as the case may be of the polypeptide of the invention. They may be structural or functional mimetics of the polypeptide, including anti-idiotypic antibodies.

One of the polypeptides identified by this invention is a ligand for the class of seven passe transmembrane receptors, which are known to be central to many biological processes and are involved in many pathologies, including heart disease, hypertension, cardiovascular disease, diabetes, insulin resistance, and obesity. Thus, the identification of chemical entities capable of agonizing the activity of the polypeptide of the invention on the one hand, and chemical entities capable of antagonizing the activity of the polypeptide of the present invention on the other hand, would be highly desirable in that they would be candidate compounds for therapeutics for such diseases related to the peptide of the present invention and its biological pathway.

Screening procedures may involve using appropriate cells which express the protein or respond to the protein. Such cells include cells from mammals, yeast, *Drosophila*, or *E. coli*. Cells that express the protein are contacted with a test compound to determine binding, or an increase or decrease in biological activity. These cells are compared to cells that have not been contacted by the compound for activity of the protein. In another embodiment, the polypeptide or a fragment thereof may be bound to a solid support, such as for example agarose beads, and a plurality of compounds would be tested for binding to the polypeptide or a fragment thereof. Those compounds shown to bind to the polypeptide could then be tested for an effect on the biological activity of the polypeptide as described using a cell based test as described above.

The polypeptide of the present invention may be used to screen for any receptors that bind to it. For example, the protein can be produced in large quantities in bacterial and/or baculovirus systems and the protein may be iodinated to search for interacting receptors in classical binding assays. Additionally, the protein may be used to identify potential inhibitors to its receptor binding activity in classical competition experiments.

The nucleic acid sequence may also be used to generate antisense molecules either synthetically in vitro or by construction of suitable expression vectors such as retroviral vectors which after introduction into desired tissues may direct the synthesis of antisense RNA in vivo.

Synthetic antisense RNA molecules may be either DNA, PNA, or RNA, or variants thereof. The term PNA (peptide nucleic acid) is used to indicate a synthetic DNA-mimetic comprising a polyamide backbone, bearing ligands at respective spaced locations along the backbone, the ligands being naturally occurring nucleobases, non-naturally occurring nucleobases, or nucleobase analogues (see, for example WO92/20703 (Buchardt, et al.); WO96/02558; and WO96/11205).

Another mechanism by which genes may be regulated at the level of mRNA is the technique of RNA interference (RNAi). In this technique, long double stranded RNAs (dsRNAs) can be used to silence the expression of target genes. Upon introduction into the cell, the long (generally >200 nt) dsRNAs enter into the RNAi pathway. The dsRNAs get cleaved into 20-25 nt small interfering RNAs (siRNAs) by Dicer, an RNAse III-like enzyme. This is the initiation step. The siRNAs assemble into complexes containing endoribonuclease known as RNA induced silencing complexes (RISCs). The siRNA molecules are then unwound to activate the RISCs. The siRNA strans guide the RISCs to complementary RNA molecules i.e. from the target gene of interest where the endoribonuclease activity digests the complementary RNA (effector step) Cleavage of the target RNA takes place near the center of the region bound by the siRNA.

The term "antisense molecule" is well known to practitioners in the art. See, for example, Molecular Biology and Biotechnology (Y' ed.) Walker and Gingold (eds.), The Royal Society of chemistry (1993) or Crooke and Bennett (1996) Ann. Rev. Pharmacol. Toxicol. 36, p. 107. An antisense molecule is capable of specifically hybridizing to a unique sequence within the sequence of a nucleic acid sequence of a peptide of the present invention. As used herein, the phrase "specifically hybridizing" means the ability of a nucleic acid (or PNA) to recognize a nucleic acid sequence complementary to its own and to form double helical (or triple helical) segment through hydrogen bonding between complementary base pairs.

Diagnostic Assays

The present invention also relates to the use of the polynucleotides for use as diagnostic reagents. Detection of a mutated form of a polypeptide that is associated with an alteration of a biological function of the polypeptide can be used as a diagnostic tool to diagnose a disease or a susceptibility to a disease that results from the overexpression, underexpression, or altered expression. Individuals carrying a mutation in the corresponding gene may be identified by a number of methods well known in the art.

Samples of nucleic acids for diagnosis may be obtained from a subjects cells, such as from blood, urine, saliva, tissue biopsy, or autopsy material. Genomic DNA may be screened directly for detection or may be amplified enzymatically using PCR or other amplification prior to analysis. RNA or cDNA may be used in a similar fashion. Deletion mutations or insertion mutations may be detected by an alteration in size of the amplified product in comparison to a product amplified from a sample containing a normal genotype. Point mutations may be detected by hybridizing the amplified product to labeled nucleotide sequences. Perfectly matched duplexes can be distinguished from duplexes containing a mismatch by RNAse digestion or by a change in the melting temperature of the duplex. Alternatively, DNA sequence differences can be detected by an alteration of electrophoretic mobility of DNA fragments in gels, with or without denaturing agents. See for example Myers, et al., Science (1985) 230:1242. Sequence changes at specific locations may be detected by nuclease protection assays including RNAse and S1. Point mutations may also be detected by single strand conformation polymorphism (SSCP) analysis.

The diagnostic assays offer a tool for diagnosing diseases or susceptibility to diseases related to obesity including, but not limited to, diabetes, hypertension, atherosclerosis, coronary artery disease, gall bladder disease, and cerebrovascular disease through the detection of mutation(s) in the adipocyte specific gene by the methods described or other methods well known in the art.

Additionally, a diagnosis of a disease or susceptibility to a disease related to obesity, such as but not limited to those mentioned hereinabove, may be performed by methods comprising determining from a sample from a subject an aberrantly increased or decreased expression of a polypeptide or its mRNA. Increases or decreases in mRNA expression can be determined by several methods well known in the art including, for example, Northern blot, quantitative real time PCR, such as the TaqMan™ system (Applied Biosystems), and RNAse protection assay. Assay methods that can determine the aberrant increased or decreased expression of a polypeptide at the protein level include, for example, Western Blot, enzyme linked immunosorbent assay (ELISA), radioimmunoassays, and competitive binding assays.

Therefore, another aspect of the invention is a kit to diagnose or diagnose the susceptibility to a disease related to obesity in a subject which comprises:

(a) an adipocyte specific polynucleotide having the nucleotide sequence of any one of SEQ ID NO: 1-277; or a fragment thereof;

(b) a nucleotide sequence complementary to that of (a)

(c) an adipocyte specific polypeptide having the sequence set forth herein, or a fragment thereof; or (d) and antibody to the adipocyte specific polypeptide.

In any such diagnostic kit, (a), (b), (c), or (d) may be a substantial component.

DEFINITIONS

Various terms relating to the biological molecules of the present invention are used throughout the specification and claims.

"Antibodies" as used herein includes polyclonal and monoclonal antibodies, chimeric, single chain, and humanized antibodies, as well as Fab fragments, including the products of an Fab or other immunoglobulin expression library. With respect to antibodies, the term, "immunologically specific" refers to antibodies that bind to one or more epitopes of a protein of interest, but which do not substantially recognize and bind other molecules in a sample containing a mixed population of antigenic biological molecules.

"Isolated" means altered "by the hand of man" from the natural state. If an "isolated" composition or substance occurs in nature, it has been changed or removed from its original environment, or both. For example, a polynucleotide or a polypeptide naturally present in a living animal is not "isolated," but the same polynucleotide or polypeptide separated from the coexisting materials of its natural state is "isolated", as the term is employed herein.

"Polynucleotide" generally refers to any polyribonucleotide or polydeoxribonucleotide, which may be unmodified RNA or DNA or modified RNA or DNA. "Polynucleotides" include, without limitation single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. In addition, "polynucleotide" refers to triple-stranded regions comprising RNA or DNA or both RNA and DNA. The term polynucleotide also includes DNAs or RNAs containing one or more modified bases and DNAs or RNAs with backbones modified for stability or for other reasons. "Modified" bases include, for example, tritylated bases and unusual bases such as inosine. A variety of modifications have been made to DNA and RNA; thus, "polynucleotide" embraces chemically, enzymatically or metabolically modified forms of polynucleotides as typically found in nature, as well as the chemical forms of DNA and RNA characteristic of viruses and cells. "Polynucleotide" also embraces relatively short polynucleotides, often referred to as oligonucleotides.

"Polypeptide" refers to any peptide or protein comprising two or more amino acids joined to each other by peptide bonds or modified peptide bonds, i.e., peptide isosteres. "Polypeptide" refers to both short chains, commonly referred to as peptides, oligopeptides or oligomers, and to longer chains, generally referred to as proteins. Polypeptides may contain amino acids other than the 20 gene-encoded amino acids. "Polypeptides" include amino acid sequences modified either by natural processes, such as posttranslational processing, or by chemical modification techniques which are well known in the art. Such modifications are well described in basic texts and in more detailed monographs, as well as in a voluminous research literature. Modifications can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched as a result of ubiquitination, and they may be cyclic, with or without branching. Cyclic, branched and branched cyclic polypeptides may result from post-translation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cystine, formation of pyroglutamate, formylation, gamma-carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination. See, for instance, PROTEINS—STRUCTURE AND MOLECULAR PROPERTIES, 2nd Ed., T. E. Creighton, W. H. Freeman and Company, New York, 1993 and Wold, F., Posttranslational Protein Modifications: Perspectives and Prospects, pgs. 1-12 in POSTTRANSLATIONAL COVALENT MODIFICATION OF PROTEINS, B. C. Johnson, Ed., Academic Press, New York, 1983; Seifter et al., "Analysis for protein modifications and nonprotein cofactors", *Meth Enzymol* (1990) 182:626-646 and Rattan et al., "Protein Synthesis: Posttranslational Modifications and Aging", *Ann NY Acad Sci* (1992) 663:48-62.

"Variant" as the term is used herein, is a polynucleotide or polypeptide that differs from a reference polynucleotide or polypeptide respectively, but retains essential properties. A typical variant of a polynucleotide differs in nucleotide sequence from another, reference polynucleotide. Changes in the nucleotide sequence of the variant may or may not alter the amino acid sequence of a polypeptide encoded by the reference polynucleotide. Nucleotide changes may result in amino acid substitutions, additions, deletions, fusions and truncations in the polypeptide encoded by the reference sequence, as discussed below. A typical variant of a polypeptide differs in amino acid sequence from another, reference polypeptide. Generally, differences are limited so that the sequences of the reference polypeptide and the variant are closely similar overall and, in many regions, identical. A variant and reference polypeptide may differ in amino acid sequence by one or more substitutions, additions, deletions in any combination. A substituted or inserted amino acid residue may or may not be one encoded by the genetic code. A variant of a polynucleotide or polypeptide may be a naturally occurring such as an allelic variant, or it may be a variant that is not known to occur naturally. Non-naturally occurring variants of polynucleotides and polypeptides may be made by mutagenesis techniques or by direct synthesis.

The term "substantially the same" refers to nucleic acid or amino acid sequences having sequence variation that do not materially affect the nature of the protein (i.e. the structure, stability characteristics, substrate specificity and/or biological activity of the protein). With particular reference to nucleic acid sequences, the term "substantially the same" is intended to refer to the coding region and to conserved sequences governing expression, and refers primarily to degenerate codons encoding the same amino acid, or alternate codons encoding conservative substitute amino acids in the encoded polypeptide. With reference to amino acid sequences, the term "substantially the same" refers generally to conservative substitutions and/or variations in regions of the polypeptide not involved in determination of structure or function.

The terms "percent identical" and "percent similar" are also used herein in comparisons among amino acid and nucleic acid sequences. When referring to amino acid sequences, "identity" or "percent identical" refers to the percent of the amino acids of the subject amino acid sequence that have been matched to identical amino acids in the compared amino acid sequence by a sequence analysis program. "Percent similar" refers to the percent of the amino acids of the subject amino acid sequence that have been matched to identical or conserved amino acids. Conserved amino acids are those which differ in structure but are similar in physical properties such that the exchange of one for another would not appreciably change the tertiary structure of the resulting protein. Conservative substitutions are defined in Taylor (1986, J. Theor. Biol. 119:205). When referring to nucleic acid molecules, "percent identical" refers to the percent of the nucleotides of the subject nucleic acid sequence that have been matched to identical nucleotides by a sequence analysis program.

"Identity" and "similarity" can be readily calculated by known methods. Nucleic acid sequences and amino acid sequences can be compared using computer programs that align the similar sequences of the nucleic or amino acids thus define the differences. In preferred methodologies, the BLAST programs (NCBI) and parameters used therein are employed, and the DNAstar system (Madison, Wis.) is used to align sequence fragments of genomic DNA sequences. However, equivalent alignments and similarity/identity assessments can be obtained through the use of any standard alignment software. For instance, the GCG Wisconsin Package version 9.1, available from the Genetics Computer Group in Madison, Wis., and the default parameters used (gap creation penalty=12, gap extension penalty=4) by that program may also be used to compare sequence identity and similarity.

With respect to single-stranded nucleic acid molecules, the term "specifically hybridizing" refers to the association between two single-stranded nucleic acid molecules of sufficiently complementary sequence to permit such hybridization under pre-determined conditions generally used in the art (sometimes termed "substantially complementary"). In particular, the term refers to hybridization of an oligonucleotide with a substantially complementary sequence contained within a single-stranded DNA or RNA molecule of the invention, to the substantial exclusion of hybridization of the oligonucleotide with single-stranded nucleic acids of non-complementary sequence.

With respect to oligonucleotides, but not limited thereto, the term "specifically hybridizing" refers to the association between two single-stranded nucleotide molecules of sufficiently complementary sequence to permit such hybridization under pre-determined conditions generally used in the art (sometimes termed "substantially complementary"). In particular, the term refers to hybridization of an oligonucleotide with a substantially complementary sequence contained within a single-stranded DNA or RNA molecule of the invention, to the substantial exclusion of hybridization of the oligonucleotide with single-stranded nucleic acids of non-complementary sequence.

The term "substantially pure" refers to a preparation comprising at least 50-60% by weight the compound of interest (e.g., nucleic acid, oligonucleotide, protein, etc.). More preferably, the preparation comprises at least 75% by weight, and most preferably 90-99% by weight, the compound of interest. Purity is measured by methods appropriate to the compound of interest (e.g. chromatographic methods, agarose or polyacrylamide gel electrophoresis, HPLC analysis, and the like).

A "coding sequence" or "coding region" refers to a nucleic acid molecule having sequence information necessary to produce a gene product, when the sequence is expressed.

The term "operably linked" or "operably inserted" means that the regulatory sequences necessary for expression of the coding sequence are placed in a nucleic acid molecule in the appropriate positions relative to the coding sequence so as to enable expression of the coding sequence. This same definition is sometimes applied to the arrangement other transcription control elements (e.g. enhancers) in an expression vector.

Transcriptional and translational control sequences are DNA regulatory sequences, such as promoters, enhancers, polyadenylation signals, terminators, and the like, that provide for the expression of a coding sequence in a host cell.

The terms "promoter", "promoter region" or "promoter sequence" refer generally to transcriptional regulatory regions of a gene, which may be found at the 5' or 3' side of the coding region, or within the coding region, or within introns. Typically, a promoter is a DNA regulatory region capable of binding RNA polymerase in a cell and initiating transcription of a downstream (3' direction) coding sequence. The typical 5' promoter sequence is bounded at its 3' terminus by the transcription initiation site and extends upstream (5' direction) to include the minimum number of bases or elements necessary to initiate transcription at levels detectable above background. Within the promoter sequence is a transcription initiation site (conveniently defined by mapping with nuclease S1), as well as protein binding domains (consensus sequences) responsible for the binding of RNA polymerase.

A "vector" is a replicon, such as plasmid, phage, cosmid, or virus to which another nucleic acid segment may be operably inserted so as to bring about the replication or expression of the segment.

The term "nucleic acid construct" or "DNA construct" is sometimes used to refer to a coding sequence or sequences operably linked to appropriate regulatory sequences and inserted into a vector for transforming a cell. This term may be used interchangeably with the term "transforming DNA". Such a nucleic acid construct may contain a coding sequence for a gene product of interest, along with a selectable marker gene and/or a reporter gene.

The term "selectable marker gene" refers to a gene encoding a product that, when expressed, confers a selectable phenotype such as antibiotic resistance on a transformed cell.

The term "reporter gene" refers to a gene that encodes a product which is detectable by standard methods, either directly or indirectly.

A "heterologous" region of a nucleic acid construct is an identifiable segment (or segments) of the nucleic acid molecule within a larger molecule that is not found in association with the larger molecule in nature. Thus, when the heterologous region encodes a mammalian gene, the gene will usually be flanked by DNA that does not flank the mammalian genomic DNA in the genome of the source organism. In another example, a heterologous region is a construct where the coding sequence itself is not found in nature (e.g., a cDNA where the genomic coding sequence contains introns, or synthetic sequences having codons different than the native gene). Allelic variations or naturally-occurring mutational events do not give rise to a heterologous region of DNA as defined herein. The term "DNA construct", as defined above, is also used to refer to a heterologous region, particularly one constructed for use in transformation of a cell.

A cell has been "transformed" or "transfected" by exogenous or heterologous DNA when such DNA has been introduced inside the cell. The transforming DNA may or may not be integrated (covalently linked) into the genome of the cell. In prokaryotes, yeast, and mammalian cells for example, the transforming DNA may be maintained on an episomal element such as a plasmid. With respect to eukaryotic cells, a stably transformed cell is one in which the transforming DNA has become integrated into a chromosome so that it is inherited by daughter cells through chromosome replication. This stability is demonstrated by the ability of the eukaryotic cell to establish cell lines or clones comprised of a population of daughter cells containing the transforming DNA. A "clone" is a population of cells derived from a single cell or common ancestor by mitosis. A "cell line" is a clone of a primary cell that can grow in vitro for many generations.

The following non-limiting examples are provided to describe the invention in greater detail. Unless otherwise specified, general cloning procedures, such as those set forth in Sambrook et al., *Molecular Cloning*, Cold Spring Harbor Laboratory (1989) (hereinafter "Sambrook et al.") or Ausubel et al. (eds) *Current Protocols in Molecular Biology*, John Wiley & Sons (2000) (hereinafter "Ausubel et al.") are used.

Experimental Details

The process of adipogenesis i.e. the generation of fat tissue occurs in order that the body is able to store energy in the form of fat, which is much more efficient than energy storage as sugar or protein. In response to an obesity inducing stimulus—such as a high fat diet—the process of adipogenesis is set in motion. Preadipocytes are cells which have not yet differentiated into mature adipocytes and therefore store no fat, but have the capacity to do so when stimulated under the proper conditions. There appear to be two connected processes occurring: there is an expansion of the number of preadipocytes via cellular proliferation, and the formation of fully developed adipocytes through differentiation. There is in fact a third process, adipocyte hypertrophy, in which the maximal amount of triglyceride has been stored in a given differentiated adipocyte which then presumably signals back to promote the proliferation of more preadipocytes and to move them through the differentiation pathway (though that mechanism remains unclear). Identifying molecular markers expressed in adipocytes, but not in preadipocytes, would be attractive targets for the prevention and treatment of obesity i.e. to prevent the formation of differentiated adipocytes and thus block the ability of these cells to accumulate fat.

The HMGI-C knockout (KO) mice were originally studied because they present with the pygmy phenotype. That is, the mice weigh only about 40% of their wild-type littermates, and this reduction in size is as a result of fewer cell number, not cell size. There are, in fact, two tissues in these animals that are exceptions: the brain, which is normal sized, and the white adipose tissue (WAT) which is decreased 8-fold. This data led us to explore a direct role for HMGI-C in adipogenesis and obesity.

We first looked at the expression of HMGI-C in the WAT of wild-type (wt) mice fed a normal chow diet versus WAT from wt mice fed a high fat diet. While HMGI-C expression was undetectable by Northern blot in the chow-fed mice, HMGI-C expression was readily detectable in the high-fat fed mice after only one week of feeding, long before any weight gain or overt phenotype can be observed. Similarly, we looked at HMGI-C expression in the genetically obese ob/ob and db/db mice. As observed in the feeding experiment, HMGI-C expression was undetectable by Northern blot in the WAT of the wt mice, but was readily detectable in the WAT of the ob/ob and db/db mice.

However, these experiments were only correlative in nature, and we thus carried out experiments to identify a causative role for HMGI-C and adipogenesis. We fed wt or HMGI-C KO mice a normal chow diet or an obesity inducing high fat diet (as above). Within 32 weeks, wt mice fed the high fat diet showed a significant increase in weight gain as compared to wt mice fed the chow diet. By contrast, HMGI-C KO mice fed a high fat diet and HMGI-C mice fed a chow diet exhibited no difference in weight gain. Thus, absence of HMGI-C was capable of preventing the weight gain induced by the physiological obesity inducing stimulus of a high fat diet.

The obesity inducing stimulus of leptin deficiency (i.e. the ob/ob mice) is much stronger than that of a high fat diet. Whereas the high fat diet may induce a 20% increase in weight, leptin deficiency induces up to a 300% gain in weight. We decided to see what the effect of HMGI-C deficiency would be in the leptin deficient mice. Mice deficient in both HMGI-C and leptin weighed the same as wt mice. This is in fact a statistically greater weight than the HMGI-C KO mice alone, but this increase was much less than would have been anticipated. [If we need to include these studies as background to the invention, they can be incorporated by reference—Anand, et al., In vivo modulation of HMGIc reduces obesity. Nat. Genet. 2000 April; 24(4):377-80].

RNA isolated from the adipose tissue from mice of the various genotypes was assayed for the expression levels of a number of preadipocyte markers (GATA3 and Pref-1, [Gregoire, 2001]) and adipocyte markers (resistin, LPL, PEPCK, AdipoQ and adipsin, [Gregoire, 2001]). Surprisingly, in comparison to wild-type adipose tissue, we found that the Hmga2 null adipose tissue expressed preadipocyte markers 10-fold higher relative to adipocyte markers. The ratio was reversed in the double homozygous mice, i.e. the ob/ob and HMGA1 mice, and this led to the following model. We hypothesized that the adipose tissue in the A2 null was mainly composed of preadipocytes and in the double homozygotes was adipocytes. Therefore, our A2 mice of various genotypes provide an enriched in vivo source of preadipocytes and adipocytes.

The next step was to perform differential gene expression analysis on RNA isolated from the epididymal white adipose tissue of the A2 null, double homozygous and wild-type mice using the Affymetrix gene chip array system.

Thus, the white adipose tissue of the HMGI-C null mice is composed predominantly of preadipocytes. This comes as a result of a deficiency in the proliferation and differentiation of preadipocytes. In the case of the HMGI-C knockout mice bred onto the leptin deficient background the presence of an overwhelming obesity stimulus forces the differentiation of those existing preadipocytes into lipid filled adipocytes. Thus, the adipose depot is almost exclusively adipocytes in these mice.

Many groups have attempted to identify obesity/diabetes targets by using "DNA chip" microarray analysis to determine differential gene expression between lean and obese mice. The drawback with this type of analysis is that the cell populations are mixed, which leads to high levels of both false positive and false negative results which leave these experiments uninterpretable.

In an initial screen we identified 46 candidate genes out of 10,000 genes contained on a single gene chip, and these results have been verified in subsequent experiments. Validation of this approach to target identification came during the analysis of these results. Of the 46 genes identified, 8 (17%) were genes undergoing active investigation as obesity/diabetes targets including AdipoQ, adipsin, β-3 adrenergic receptor, PEPCK, IGF-1, aP2, leptin, and resistin. This positive strike rate is remarkable and, as far as we know, unparalleled in other systems. The fact that these genes came up as targets in our analysis validates this approach to identify obesity targets.

We then isolated total RNA samples from the mice and subjected them to differential gene expression analysis using the Affymetrix system and then set up a numerical algorithm to arrive at the results, as follows:

The sequences of the inventions were obtained by differential expression analysis using the Affymetrix GeneChip system.

Animals:

Total RNA was isolated from the white adipose tissue (WAT) from mice of the following genotypes:

1) wild-type; 2) HMGI-C −/−; 3) ob/ob; and 4) HMGI-C −/−, ob/ob.

Total RNA was also isolated from the stromal vascular tissue (SVT) of mice of the following genotypes:

1) wild-type 2) ob/ob

3) HMGI-C −/−, ob/ob

Isolation of the Total RNA

The total RNA was isolated using the RNeasy (Quiagen) kit as follows:

RNA cleanup (Qiagen Rneasy):

add water to 100 ul add 350 ul Buffer RLT, mix add 250 ul 100% ETOH, mix, label column/cap and collection tube apply to RNeasy column, wait 3 min, spin (all spins >10,000 rpm) 30 sec re-apply flow-through wait 3 min, spin 30 sec transfer column into a new 2 ml collection tube, add 500 ul Buffer RPE, spin 30 sec discard flow-through, add 500 ul Buffer RPE, spin 2 min, discard flow-through, spin additional 3 min uncapped, you may cut off caps, make sure columns are labeled, transfer column to a 1.5 ml collection tube with both the tube and cap labeled let sit on bench uncapped 3 min add 100 ul water, soak 3 min, spin 2 min take 2 ul for OD in 48 ul water freeze sample in −70° C., speed vac at low heat, do not dry completely resuspend pellet with water to 1 ug/ul run 1 ug on gel The Affymetrix GeneChip Analysis:

RNA cleanup (Qiagen Rneasy):

add water to 100 ul add 350 ul Buffer RLT, mix add 250 ul 100% ETOH, mix, label column/cap and collection tube apply to RNeasy column, wait 3 min, spin (all spins >10,000 rpm) 30 sec re-apply flow-through wait 3 min, spin 30 sec transfer column into a new 2 ml collection tube, add 500 ul Buffer RPE, spin 30 sec discard flow-through, add 500 ul Buffer RPE, spin 2 min, discard flow-through, spin additional 3 min uncapped, you may cut off caps, make sure columns are labeled, transfer column to a 1.5 ml collection tube with both the tube and cap labeled let sit on bench uncapped 3 min add 100 ul water, soak 3 min, spin 2 min take 2 ul for OD in 48 ul water freeze sample in −70° C., speed vac at low heat, do not dry completely resuspend pellet with water to 1 ug/ul run 1 ug on gel Affymetrix Differential Expression Analysis The Affymetrix differential expression analysis was performed on the MG-U74 "A" chip using the detailed protocols in the attached manual. Briefly, the Affymetrix analysis proceeds as follows:

The following major steps outline GeneChip® Expression Analysis:

1. Target Preparation

2. Target Hybridization

3. Experiment and Fluidics Station Setup

4. Probe Array Washing and Staining

5. Probe Array Scan

6. Data Analysis

Step 1: Target Preparation

Double-stranded cDNA is synthesized from total RNA or purified poly(A)+messenger RNA isolated from tissue or cells. An in vitro transcription (IVT) reaction is then done to produce biotin-labeled cRNA from the cDNA. The cRNA is fragmented before hybridization. After fragmentation, the RNA is end-modified and conjugated with biotin.

Step 2: Target Hybridization

A hybridization cocktail is prepared, including the fragmented target, probe array controls, BSA, and herring sperm DNA. It is then hybridized to the probe array during a 16-hour incubation. The hybridization process is described in the respective sections for the different probe array types.

Step 3: Experiment and Fluidics Station Setup

Specific experimental information is defined using Affymetrix® Microarray Suite on a PC-compatible workstation with a Windows NT operating system. The probe array type, sample description and comments are entered in Microarray Suite and saved with a unique experiment name. The fluidics station is then prepared for use by priming with the appropriate buffers.

Step 4: Probe Array Washing and Staining

Immediately following hybridization, the probe array undergoes an automated washing and staining protocol on the fluidics station.

Step 5: Probe Array Scan

Once the probe array has been hybridized, washed and stained, it is scanned. Each workstation running Affymetrix® Microarray Suite can control one scanner. Each probe array is scanned twice, taking up to ten minutes, depending on the array format. The software calculates an average of the two images, defines the probe cells and computes an intensity for each cell. The double scan improves assay sensitivity and reduces background noise. Each complete probe array image is stored in a separate data file identified by the experiment name and is saved with a data image file (.dat) extension.

Step 6: Data Analysis

Data is analyzed using Microarray Suite Expression Analysis window. The .dat image is analyzed for probe intensities; results are reported in tabular and graphical formats. The data collected were transferred from Affymetrix Microarray Suite 4.0 to Genespring 4.1.1 (Silicon Genetics) for analysis. The following sets of genes were then selected:

1. Genes showing an expression increase of 7× or greater comparing wild-type WAT vs. HMGI-C −/− WAT 2. Genes showing an expression increase of 5× or greater comparing wild-type SVT vs. wild-type WAT 3. Genes showing an expression increase of 7× or greater comparing HMGI-C−/, ob/ob WAT vs. HMGI-C−/− WAT.

A Venn diagram was then made to identify overlap in the above three sets of selected genes. This resulted in 300 genes being selected. The genes were then further filtered as follows. Genes indicating an "absent" call according to the Affymetrix analysis in both wild-type WAT and HMGI-C−/−, ob/ob WAT were eliminated. All ESTs were eliminated and all Ig genes were eliminated. Genes that showed an absolute expression level less than 500 units by the Affymetrix analysis were also eliminated, resulting in the list that you now have. The sequences from these genes were available from GenBank (Affymetrix supplies the accession numbers). Human homologs of the identified mouse sequences were found via BLAST search of the NCBI database.

Variables in the Method

Parameters in this system can be varied. For example, we know that the HMGI-C KO mice have WAT composed predominantly of preadipocytes, and that leptin deficiency in these mice forces the differentiation of these preadipocytes into adipocytes, but there is still a blockade on the proliferation of new preadipocytes i.e. the WAT is now composed predominantly of adipocytes. It is possible, however, that there are other mouse models in which the WAT is mostly preadipocytes and that adding leptin deficiency to the background would result in mice with mostly adipocytes in the WAT. We predict that crossing the HMGI-C KO mice with the db/db mice would give exactly the same result, hence there may be other KO or transgenic animals that when crossed with the HMGI-C KO mice would result in mice with mostly adipocytes.

Isolation of total RNA is possible by many methods well known to those in the art, from CsCl gradients to triazol reagents to kits containing RNA affinity columns (such as the Rneasy kit mentioned.

There are also alternatives to using the Affymetrix system for the microarrays. There are other systems commercially available e.g. the Rosetta Resolver system. Invitrogen will produce custom arrays (albeit at great expense). It is even possible for one to make "home made" arrays in the laboratory, though this is time consuming, labor intensive, and is generally of much poorer quality than those commercially available.

The cutoffs used in the experimental analysis are also variable:

1. Genes showing an expression increase of 7× or greater comparing wild-type WAT vs. HMGI-C −/− WAT 2. Genes showing an expression increase of 5× or greater comparing wild-type SVT vs. wild-type WAT 3. Genes showing an expression increase of 7× or greater comparing HMGI-C−/, ob/ob WAT vs. HMGI-C−/− WAT.

Elimination of genes that showed an absolute expression level less than 500 units The cutoffs in the algorithm were chosen because they include the 8 well characterized adipogenic genes. Reducing the cutoffs or raising the bar on absolute expression would result in more genes, but as the list grows it becomes harder to defend those as legitimate obesity targets e.g if we raise the cutoff for absolute expression from 500 to 80,000 we include essentially all 10,000 genes on the chip. Of course the converse is true; if we raise the cutoff, the number of genes becomes less, though not all 8 adipogenic genes will be represented e.g. leptin was #26 on the list, therefore increasing the cutoff to result in only 25 genes eliminates all of the known adipogenic genes. While the inclusion of all of the known adipogenic genes gives the method its validity, once validity has been established, increasing the cutoff would simply identify highly expressed adipogenic genes.

The sequences identified by this method of Affymetrix differential gene expression analysis and real time quantitative PCR are listed in this specification in the section immediately preceding the claims.

Identified Adipocyte Specific Sequences 1-83

AF064748. *Mus musculus* S3-1 . . . [gi:3236367] (SEQ. ID. NO. 501) & (SEQ. ID. NO. 1)

Human homolog

XM_069431. *Homo sapiens* simi . . . [gi:18564480] (SEQ. ID. NO.502) & (SEQ. ID. NO. 2)

XM_069427. *Homo sapiens* simi . . . [gi:17464283] (SEQ. ID. NO. 503) & (SEQ. ID. NO. 3)

Neuronatin-1

X83568. *M. musculus* mRNA f . . . [gi:619497] (SEQ. ID. NO. 504) & (SEQ. ID. NO. 4)

Human Homolog

XM_009686. *Homo sapiens* neur . . . [gi: 18591751] (SEQ. ID. NO. 505) & (SEQ. ID. NO.5)

Neuronatin-2

X83569. *M. musculus* mRNA f . . . [gi:619499] (SEQ. ID. NO. 506) & (SEQ. ID. NO. 6)

Human Homolog

U25034. Human neuronatin . . . [gi:1244409d no] (SEQ. ID NO 507) & (SEQ. ID. NO. 7)

Neuronatin-3

X83570. *M. musculus* mRNA f . . . [gi:619501] (SEQ. ID. NO. 508) & (SEQ. ID. NO. 508)

Human Homolog

XM_009686. *Homo sapiens* neur . . . [gi:18591751] (SEQ. ID. NO. 509) & (SEQ. ID. NO.9)

VAP-1

AF078705. *Mus musculus* vasc . . . [gi:3603354] (SEQ. ID. NO. 510) & (SEQ. ID. NO. 10)

Human Homolog

AF067406. *Homo sapiens* vasc . . . [gi:3283369] (SEQ. ID. NO. 511) & (SEQ. ID. NO. 11)

FSP27

M61737. *M. musculus* adipoc . . . [gi:201107] (SEQ. ID. NO. 12)

Human Homolog

NM_022094. *Homo sapiens* hypo . . . [gi: 11545806] (SEQ. ID. NO.513) & (SEQ. ID. NO. 13)

MRP14

AF240177. *Mus musculus* MRP1 . . . [gi:13877300] (SEQ. ID. NO. 14)

NP_033140. S100 calcium-bind . . . [gi:6677837]

Peg1/Mest

AF017994. *Mus musculus* Peg1 . . . [gi:2570405] (SEQ. ID. NO.515) & (SEQ. ID. NO. 15)

Human homolog

D87367. *Homo sapiens* PEG1 . . . [gi:2317667] (SEQ. ID. NO. 516) & (SEQ. ID. NO. 16)

CD1d1 antigen

M63695. Mouse CD1.1 mRNA, . . . [gi:192471] (SEQ. ID. NO.517) & (SEQ. ID. NO. 17)

Human Homolog

NM_001766. *Homo sapiens* CD1D . . . [gi:4502648] (SEQ. ID. NO.518) & (SEQ. ID. NO.18)

Gamma Synuclein

F017255. *Mus musculus* pers . . . [gi:4090844] (SEQ. ID. NO. 519) & (SEQ. ID. NO. 19)

Human homolog

AF411524. *Homo sapiens* synu . . . [gi: 15705904] (SEQ. ID. NO.520) & (SEQ. ID. NO.20)

CD53 Antigen

1: X97227. *M. musculus* mRNA f . . . [gi:1279545] (SEQ. ID. NO.21) & (SEQ. ID. NO.21)

Human homolog

M60871. Human cell surfac . . . [gi:180140] (SEQ. ID. NO. 522) & (SEQ. ID. NO. 22)

Beta 1,3-galactosyltransferase

AF029791. *Mus musculus* UDP- . . . [gi:2745736] (SEQ. ID. NO. 523) & (SEQ. ID. NO. 23)

Human Homolog

Y15014. *Homo sapiens* mRNA . . . [gi:2791314] (SEQ. ID. NO. 524) & (SEQ. ID. NO. 24)

Retinol Binding Protein 4

U63146. *Mus musculus* reti . . . [gi: 1515449] (SEQ. ID. NO. 525) & (SEQ. ID. NO. 25)

Human Homolog

NM_006744. *Homo sapiens* reti . . . [gi:8400727] (SEQ. ID. NO. 526) & (SEQ. ID. NO. 26)

ATP-Binding Cassette, Sub-Family D, 2

Z48670. *M. musculus* mRNA f . . . [gi: 1107731] (SEQ. ID. NO. 527) & (SEQ. ID. NO. 27)

Human homolog

NM_005164. *Homo sapiens* ATP- . . . [gi:9945307] (SEQ. ID. NO.528) & (SEQ. ID. NO.28)

Small Inducible Cytokine A6

NM_009139. *Mus musculus* smal . . . [gi:6677882] (SEQ. ID. NO.529) & (SEQ. ID. NO.29)

Myeloperoxidase

X15313. Mouse MPO mRNA fo . . . [gi:53203] (SEQ. ID. NO. 530) & (SEQ. ID. NO. 30)

Human Homolog

NM_000250. *Homo sapiens* myel . . . [gi:4557758] (SEQ. ID. NO.531) & (SEQ. ID. NO.31)

Coronin, Actin-Binding Protein 1A

NM_009898. *Mus musculus* coro . . . [gi:6753491] (SEQ. ID. NO. 532) & (SEQ. ID. NO.32)

Human Homolog

X89109. *H. sapiens* mRNA fo . . . [gi: 1136139] (SEQ. ID. NO. 533) & (SEQ. ID. NO. 33)

Early B-Cell Factor (EBF)

L12147. *Mus musculus* (clo . . . [gi:309208] (SEQ. ID. NO. 534) & (SEQ. ID. NO. 34)

Human homolog

XM_038441. *Homo sapiens* earl . . . [gi: 18562089] (SEQ. ID. NO.535) & (SEQ. ID. NO.35)

Small Inducible Cytokine A5

AF065947. *Mus musculus* stra . . . [gi:3158455] (SEQ. ID. NO. 36)

Human Homolog

XM_035842. *Homo sapiens* smal . . . [gi:14773546] (SEQ. ID. NO. 37)

Matrix Metalloproteinase 9

X72795. *M. musculus* mRNA f . . . [gi:433434] (SEQ. ID. NO. 538) & (SEQ. ID. NO. 38)

Human Homolog

NM_004994. *Homo sapiens* matr . . . [gi:4826835] (SEQ. ID. NO. 539) & (SEQ. ID. NO.39)

PTPase Receptor Type C

M14343. Mouse Ly-5 (leuco . . . [gi:198918] (SEQ. ID. NO. 40)

Human Homolog

NM_080922. *Homo sapiens* prot . . . [gi: 18641363] (SEQ. ID. NO.541)(SEQ. ID. NO.41)

Aspartic Protease-Like Protein

D88899. Mouse mRNA for ki . . . [gi:1906809] (SEQ. ID. NO. 542) & (SEQ. ID. NO. 42)

Human Homolog

NM_004851. *Homo sapiens* pron . . . [gi:4758753] (SEQ. ID. NO. 543) & (SEQ. ID. NO.43)

Eosinophil-Associated Ribonuclease 1

1: U72032. *Mus musculus* eosi . . . [gi: 1695898] (SEQ. ID. NO. 544) & (SEQ. ID. NO. 44)

Hematopoietic Cell Specific Lyn Substrate 1

X84797. *M. musculus* mRNA s . . . [gi:683480] (SEQ. ID. NO. 545) & (SEQ. ID. NO. 45)

Human Homolog

NM_005335. *Homo sapiens* hema . . . [gi:4885404] (SEQ. ID. NO.546) & (SEQ. ID. NO.46)

Rhom-2

M64360. Mouse rhom-2 mRNA . . . [gi:200748] (SEQ. ID. NO. 547) & (SEQ. ID. NO. 47)

Human homolog

NM_005574. *Homo sapiens* LIM . . . [gi:6633806] (SEQ. ID. NO.548) & (SEQ. ID. NO.48)

G-Protein, Alpha Inhibiting 1

U38501. *Mus musculus* G pr . . . [gi:1353505] (SEQ. ID. NO. 49)

Human Homolog

NM_002070. *Homo sapiens* guan . . . [gi:4504040] (SEQ. ID. NO.550) & (SEQ. ID. NO.50)

Nicotinamide N-methytransferase

U86108. *Mus musculus* nico . . . [gi:2738008] (SEQ. ID. NO. 551) & (SEQ. ID. NO. 51)

Human Homolog

NM_006169. *Homo sapiens* nico . . . [gi:5453789] (SEQ. ID. NO. 552) & (SEQ. ID. NO.52)

LMP2iran allele

D44456. *Mus musculus* bact . . . [gi:2467350] (SEQ. ID. NO. 553) & (SEQ. ID. NO. 53)

Human Homolog

: XM_165798[gi:20555527] (SEQ. ID. NO. 554) & (SEQ. ID. NO. 54)

Guanylate Nucleotide Binding Protein 2

AJ007970. *Mus musculus* mRNA . . . [gi:4158171] (SEQ. ID. NO.555) & (SEQ. ID. NO.55)

Human Homolog

XM_001804. *Homo sapiens* guan . . . [gi: 18548646] (SEQ. ID. NO.556) & (SEQ. ID. NO.56)

Proteinase 3

U43525. *Mus musculus* pre- . . . [gi:1165220] (SEQ. ID. NO. 557) & (SEQ. ID. NO. 57)

Human Homolog

XM_009264. *Homo sapiens* prot . . . [gi: 18590908] (SEQ. ID. NO.558) & (SEQ. ID. NO.58)

G Protein Gamma 2 Subunit

AF098489. *Mus musculus* G pr . . . [gi:4323235] (SEQ. ID. NO. 559) & (SEQ. ID. NO. 59)

Human homolog

XM_090816. *Homo sapiens* simi . . . [gi:18597218] (SEQ. ID. NO. 583)(SEQ. ID. NO. 83)

CSF 2 Receptor, beta 1

M34397. Mouse interleukin . . . [gi:19182] (SEQ. ID. NO. 560) & (SEQ. ID. NO. 60)

Human homolog

NM_000395. *Homo sapiens* colo . . . [gi:4559407] (SEQ. ID. NO. 561) & (SEQ. ID. NO.61)

Leukocyte Common Antigen

: M23158. Mouse leucocyte c . . . [gi:198752] (SEQ. ID. NO. 562) & (SEQ. ID. NO. 62)

Human Homolog

Y00638. Human mRNA for le . . . [gi:34280] (SEQ. ID. NO. 563) & (SEQ. ID. NO. 63)

Sonic Hedgehog Homolog

X76290. *M. musculus* (C57BL . . . [gi:2597987] (SEQ. ID. NO. 564) & (SEQ. ID. NO. 64)

Human Homolog

L38518. *Homo sapiens* soni . . . [gi:663156] (SEQ. ID. NO. 565) & (SEQ. ID. NO. 65)

BIT

D85785. Mouse mRNA for BI . . . [gi:2190256] (SEQ. ID. NO. 566) & (SEQ. ID. NO. 66)

Human Homolog

AB023430. *Homo sapiens* Bit . . . [gi:6518912] (SEQ. ID. NO. 567) & (SEQ. ID. NO. 67)

Vanin 3

AJ132103. *Mus musculus* mRNA . . . [gi:6102995] (SEQ. ID. NO.568) & (SEQ. ID. NO.68)

Human Homolog

AJ238982. *Homo sapiens* mRNA . . . [gi:7160972] (SEQ. ID. NO.569) & (SEQ. ID. NO. 69)

Kruppel-Like Factor 7

NM_033563. *Mus musculus* Krup . . . [gi: 15808991] (SEQ. ID. NO.570) & (SEQ. ID. NO.70)

Human Homolog

NM_003709. *Homo sapiens* Krup . . . [gi:4507828] (SEQ. ID. NO.571) & (SEQ. ID. NO.71)

Nitric Oxide Sythase 3, Endothelial Cell

U53142. *Mus musculus* endo . . . [gi:1518955] (SEQ. ID. NO. 572) & (SEQ. ID. NO. 72)

Human homolog

AF400594. *Homo sapiens* endo . . . [gi: 15077875] (SEQ. ID. NO. 573) & (SEQ. ID. NO. 73)

Paired-Ig-Like Receptor A1

U96682. *Mus musculus* immu . . . [gi:2138352] (SEQ. ID. NO. 574) & (SEQ. ID. NO. 74)

Human homolog

XM_17977. *Homo sapiens* leuk . . . [gi:20546205] (SEQ. ID. NO.575) & (SEQ. ID. NO.75)

Voltage-Dependent NA+ Channel beta-1

L48687. *Mus musculus* volt . . . [gi:1162950] (SEQ. ID. NO. 576) & (SEQ. ID. NO. 76)

Human Homolog

U12192. *Homo sapiens* volt . . . [gi:619588] (SEQ. ID. NO. 577) & (SEQ. ID. NO. 77)

Chemokine (C—C) Receptor 2

1: U56819. *Mus musculus* mcp- . . . [gi:1532146] (SEQ. ID. NO. 578) & (SEQ. ID. NO. 78)

Human Homolog

NM_000648. *Homo sapiens* chem . . . [gi:4757937] (SEQ. ID. NO.579)(SEQ. ID. NO.79)

Interferon Regulatory Factor 4

U20949. *Mus musculus* lymp . . . [gi:972947] (SEQ. ID. NO. 580) & (SEQ. ID. NO. 80

Human Homolog

XM_165802[gi:20556306] (SEQ. ID. NO. 581) & (SEQ. ID. NO. 81)

| Seq ID No. | Accession No. | Comments |
|---|---|---|
| 89 | AK017227 | |
| 90 | BC004897 | Human homolog to 89 |
| 91 | AK080414 | |
| 92 | AAG23122 | Human homolog to 91 |
| 94 | NM_008728 | |
| 95 | M59305 | Human homolog to 94 |
| 101 | NM_144930 | |
| 102 | BAA84996 | Human homolog to 101 |
| 103 | NM_018780 | |
| 104 | NM_003015 | Human homolog to 103 |
| 113 | NM_023184 | |
| 114 | NM_014079 | Human homolog to 113 |
| 118 | BC030733 | |
| 119 | NBHUA2 | Human homolog to 118 |
| 120 | NM_019516 | |
| 121 | BC028222 | Human homolog to 120 |
| 126 | NM_152801 | |
| 127 | BC039856 | Human homolog to 126 |
| 134 | XM_284386 | |
| 136 | NM_008521 | |
| 137 | NM_145867 | Human homolog to 136 |
| 141 | NM_133198 | |
| 142 | NM_002863 | Human homolog to 141 |
| 143 | NM_026772 | |
| 144 | NM_006779 | Human homolog to 143 |
| 146 | AK039295 | |
| 147 | AY090098 | |
| 152 | NM_010016 | |
| 153 | AAA52168 | Human homolog to 152 |
| 154 | NM_008522 | |
| 155 | AAA58656 | Human homolog to 154 |
| 156 | NM_019549 | |
| 157 | NM_002664 | Human homolog to 156 |
| 158 | NM_011994 | |
| 159 | NM_005164 | Human homolog to 159 |
| 161 | NM_148938 | |
| 162 | NM_004172 | Human homolog to 161 |
| 163 | NM_053268 | |
| 164 | NM_006506 | Human homolog to 163 |
| 165 | NM_007487 | |
| 166 | BC039123 | Human homolog to 165 |
| 167 | NM_145491 | |
| 168 | XM_209429 | Human homolog to 167 |
| 279 | NM_025829 | |
| 169 | BC031289 | Human homolog to 279 |
| 170 | NM_147220 | |
| 171 | NM_080283 | Human homolog to 170 |
| 173 | NM_011186 | |
| 174 | NM_002797 | Human homolog to 173 |
| 185 | NM_153507 | |
| 186 | NM_152727 | Human homolog to 185 |
| 193 | NM_021886 | |
| 194 | NM_022909 | Human homolog to 193 |
| 195 | NM_007387 | |
| 196 | NM_001610 | Human homolog to 195 |
| 197 | NM_013739 | |
| 198 | NM_024872 | Human homolog to 198 |
| 202 | BC029248 | |
| 203 | AAG59827 | Human homolog to 202 |
| 204 | NM_009381 | |
| 205 | BC031989 | Human homolog to 204 |
| 206 | NM_053186 | |
| 207 | NM_017623 | Human homolog to 206 |
| 208 | NM_019560 | |
| 209 | NM_052874 | Human homolog to 208 |
| 212 | NM_029999 | |
| 213 | NM_030915 | Human homolog to 212 |
| 225 | AK028281 | |
| 226 | NP_001287 | Human homolog to 225 |
| 230 | AK089391 | |
| 234 | BC034872 | |
| 235 | NM_005292 | Human homolog to 234 |
| 237 | AK037228 | |
| 238 | XP_211590 | Human homolog to 237 |
| 257 | NM_139138 | |
| 258 | AY181245 | Human homolog to 257 |
| 265 | NM_130905 | |
| 266 | NM_021155 | Human homolog to 265 |
| 270 | XM_286373 | |
| 271 | XM_211303 | Human homolog to 270 |
| 274 | NM_010260 | |
| 275 | AL832451 | Human homolog to 274 |

Along with identifying known genes and known obesity targets, the disclosed method also identified sequences that have not been characterized and sequences whose function has until now not been discovered.

The following table lists the Accession number for sequences that have until now been "ESTs", i.e. unknown.

| Seq ID. No. | Accession Number | Seq ID/Accession-seq. unknown Comments |
|---|---|---|
| 86 | AI536451 | |
| 87 | AA880159 | |
| 93 | AI643872 | |
| 96 | AI876264 | |
| 115 | AK029114 | |
| 116 | AB046799 | Human homolog to 115 |
| 117 | AK084680 | |
| 135 | AI843070 | |
| 140 | AI429810 | |
| 145 | AI841502 | |
| 148 | AW123926 | |
| 151 | AI593942 | |
| 160 | AI131739 | |
| 172 | AA178128 | |
| 179 | XM_287203 | |
| 180 | NM_020182 | Human homolog to 179 |
| 191 | AV293830 | |
| 192 | BC040983 | Human homolog to 191 |
| 201 | AI661950 | |
| 223 | AW049306 | |
| 224 | AI839459 | |
| 229 | AI413635 | |
| 236 | AI465892 | |
| 246 | AI021175 | |
| 255 | NM_033524 | |
| 256 | NM_152594 | Human homolog to 255 |
| 263 | AA914137 | |
| 264 | AI842280 | |
| 267 | AV376576 | |
| 268 | AI593010 | |
| 276 | AK046027 | |
| 277 | AB020644 | |

The following table lists the Accession numbers for sequences whose function has until now been unknown:

| Seq ID | Accession Number | Comments |
|---|---|---|
| 84 | NM_144936 | |
| 85 | NM_138788 | Human homolog to 84 |
| 88 | XM_110133 | |
| 97 | BC037624 | |
| 98 | AK057179 | Human homolog to 97 |
| 99 | BC026527 | |
| 100 | XP_085101 | Human homolog to 99 |
| 105 | AK090296 | |
| 106 | NM_000106 | Human homolog to 105 |
| 107 | AK046700 | |
| 108 | NM_032554 | Human homolog to 107 |
| 109 | AK087428 | |
| 110 | BAB85539 | Human homolog to 109 |

-continued

| Seq ID | Accession Number | Comments |
|---|---|---|
| 111 | AK079549 | |
| 112 | NP_620145 | Human homolog to 111 |
| 115 | AK029114 | |
| 116 | AB046799 | Human homolog to 115 |
| 117 | AK084680 | |
| 122 | AK088119 | |
| 123 | BC035630 | Human homolog to 122 |
| 124 | XM_112637 | |
| 125 | XP_032996 | Human homolog to 124 |
| 128 | AK017670 | |
| 129 | BC027926 | Human homolog to 128 |
| 130 | AK017670 | |
| 131 | BC022276 | Human homolog to 130 |
| 132 | AK032359 | |
| 133 | XP_087331 | Human homolog to 132 |
| 138 | AK045363 | |
| 139 | BC047588 | Human homolog to 138 |
| 149 | BC024883 | |
| 150 | BC039867 | Human homolog to 149 |
| 175 | BC018156 | |
| 176 | XM_031536 | Human homolog to 175 |
| 177 | AK048450 | |
| 178 | BC039591 | Human homolog to 177 |
| 181 | BC024788 | |
| 182 | NM_024074 | Human homolog to 181 |
| 183 | XM_125708 | |
| 184 | BC035564 | Human homolog to 183 |
| 187 | NM_027349 | |
| 188 | AL832314 | Human homolog to 187 |
| 189 | NM_025629 | |
| 190 | BC040620 | Human homolog to 189 |
| 199 | AK012494 | |
| 200 | XM_058800 | Human homolog to 199 |
| 210 | AK031989 | |
| 211 | XP_229579 | Human homolog to 210 |
| 214 | NM_029509 | |
| 215 | BC008421 | Human homolog to 214 |
| 216 | AK029076 | |
| 217 | XM_113636 | Human homolog to 217 |
| 218 | AK048344 | |
| 219 | NM_145479 | |
| 220 | NM_032775 | Human homolog to 219 |
| 221 | NM_026170 | |
| 222 | AAG44724 | Human homolog to 221 |
| 227 | NM_139269 | |
| 228 | AF317086 | Human homolog to 227 |
| 232 | BC031142 | |
| 233 | BC036468 | Human homolog to 232 |
| 239 | AK045646 | |
| 240 | NM_016644 | Human homolog to 239 |
| 241 | NM_027863 | |
| 242 | BC016653 | Human homolog to 241 |
| 243 | BC031419 | |
| 244 | BC039067 | Human homolog to 243 |
| 245 | XM_147934 | |
| 247 | AK048759 | |
| 248 | NM_012414 | Human homolog to 247 |
| 249 | NM_175035 | |
| 250 | NP_060854 | Human homolog to 249 |
| 251 | AK037116 | |
| 252 | BC049196 | Human homolog to 252 |
| 253 | BC027174 | |
| 254 | NM_015147 | Human homolog to 254 |
| 255 | NM_033524 | |
| 256 | NM_152594 | Human homolog to 256 |
| 259 | AK038853 | |
| 260 | AY033237 | Human homolog to 259 |
| 261 | AK084351 | |
| 262 | BC042872 | Human homolog to 261 |
| 268 | AI593010 | |
| 272 | NM_053247 | |
| 273 | NM_006691 | Human homolog to 272 |

Identification of sFRP-5 as an Adipocyte Specific Gene

Of the identified genes, one identified gene modulated by the presence or absence of HMGI-C, upregulated by itself in an autocrine manner, which is involved in the regulation of adipose accumulation, is SFRP-5. The gene was identified by the described method.

"sFRP-5" refers generally to a polypeptide in accordance with the present invention, which is described in detail throughout the specification. "sFRP-5 gene" refers to a polynucleotide as defined above in accordance with the present invention, which encodes an sFRP-5 polypeptide.

"sFRP-5 activity or sFRP-5 polypeptide activity" or "biological activity of the s-FRP-1 or sFRP-5 polypeptide" refers to the metabolic or physiologic function of said sFRP-5 including similar activities or improved activities or these activities with decreased undesirable side-effects. Also included are antigenic and immunogenic activities of said sFRP-5. In particular, sFRP-5 is a protein that is in the HMGI-C pathway and that is upregulated in adipogenesis and obesity. The sFRP-1 protein of the present invention is dependent upon HMGI-C for normal levels of expression. Moreover, the sFRP-5 of the present invention acts in an autocrine fashion to upregulate its own expression in adipocytes.

As described above, the expression of this gene is dependent on HMGI-C in normal adipose tissue and upregulates its own expression in adipocytes. Computer analysis (BLAST search) of the open reading frame of the gene revealed no significant similarity to either the mammalian ob or tub genes.

The sFRP-5 polynucleotides of the present invention includes isolated polynucleotides encoding the sFRP-5 polypeptides and fragments, and polynucleotides closely related thereto. More specifically, sFRP-5 polynucleotide of the invention include a polynucleotide comprising the human nucleotide sequences contained in SEQ ID NO:103 encoding a sFRP-1 polypeptide of SEQ ID NO: 603, and polynucleotides having the particular sequence of SEQ ID NO:103. sFRP-5 polynucleotides further include a polynucleotide comprising a nucleotide sequence that has at least 91% identity over its entire length to a nucleotide sequence encoding the sFRP-5 polypeptide of SEQ ID NO:603, and a polynucleotide comprising a nucleotide sequence that is at least 91% identical to that of SEQ ID NO:103, wherein identity is calculated over the entire length of the reference polynucleotide or polypeptide, for example, SEQ ID NO:103. In this regard, polynucleotides with at least 70% are preferred, more preferably at least 80% identity, even more preferably at least 90% identity, yet more preferably at least 95% identity, 97% are highly preferred and those with at least 98-99% are most highly preferred, with at least 99% being the most preferred. Also included under sFRP-5 polynucleotides are a nucleotide sequence which has sufficient identity to a nucleotide sequence contained in SEQ ID NO:103 to hybridize under conditions useable for amplification or for use as a probe or marker. The invention also provides polynucleotides which are complementary to such sFRP-5 polynucleotides. In preferred embodiments, the polynucleotides are fully complementary to sFRP-5 over the entire length of the reference polynucleotide.

A. SEQ ID NO: 103
```
   1 ggcggggtg ggaggtgagg gggaccagcg gctgcagatt ggctagggaa cggcgaagcc
  61 tgggctggag ccccgtggtg ggaggcgcct ggatcactcc ggcagcggag cggagcagag
 121 actgccacct acttggacga ccctagtagc agccggcttc agggaacatc cagccgggg
 181 cgcacgccgg gcagcggggc gccgagcacc gagccgtcgg ggcaggccgc aacatccagc
 241 catgtgggtg gcctggagcg cacggacggc cgcactggcg ttgctgctcg ggcgctgca
 301 tggggcgcca acacgcggcc aggagtacga ctactacggt tggcaggccg agccgctgca
 361 cggccgctcc tactccaagc caccgcagtg cctcgacatc cccgccgatc tgccgctctg
 421 tcacacggtg ggctacaagc gcatgcggct gcccaacctg ctggagcacg agagcctggc
 481 cgaggtgaag cagcaggcaa gcagctggct gccactgctg ccaagcgct gccactcaga
 541 cacccaggtc ttcctctgct cgctcttcgc tcccgtctgc ctggaccgac catctaccc
 601 ctgccgctcg ctgtgcgaag ctgcgcgcgc cggctgcgct ccgctcatgg aggcctacgg
 661 tttcccttgg cccgagatgc tgcactgcca caagttcccc ctggacaacg acctctgcat
 721 cgcggtgcag ttcgggcacc tgcctgccac cgcgcctcca gtgaccaaga tctgtgccca
 781 gtgtgagatg gagcacagcg ctgacggcct catggaacag atgtgctcca gtgactttgt
 841 ggtcaagatg cgcattaagg agatcaagat agacaacggg gaccgaaagt tgattggagc
 901 ccagaagaag aagaagctgc tcaaggcagg ccccttaaag cgcaaggaca ccaagaagct
 961 ggtcctgcat atgaagaacg gggcaagctg cccttgccca caattagaca acctgacggg
1021 cagcttcctg gtcatgggcc gcaaagtaga gggacagctg ctgctcacgg ccgtctaccg
1081 ctgggacaag aagaataagg agatgaagtt tgcggtcaaa ttcatgttct cctatccctg
1141 ttccctctac tacccttttt tctatggggc agctgaaccc cactga
```

B. SEQ ID NO: 603

MWVAWSARTAALALLLGALHGAPTRGQEYDYYGWQAEPLHGRSYSKPPQCLDIPADLPLCHTVGYKRMRL
PNLLEHESLAEVKQQASSWLPLLAKRCHSDTQVFLCSLFAPVCLDRPIYPCRSLCEAARAGCAPLMEAYG
FPWPEMLHCHKFPLDNDLCIAVQFGHLPATAPPVTKICAQCEMEHSADGLMEQMCSSDFVVKMRIKEIKI
DNGDRKLIGAQKKKKLLKAGPLKRKDTKKLVLHMKNGASCPCPQLDNLTGSFLVMGRKVEGQLLLTAVYR
WDKKNKEMKFAVKFMFSYPCSLYYPFFYGAAEPH

C. SEQ ID NO: 104
```
   1 gaggcgccag gatcagtcgg ggcacccgca gcgcaggctg ccacccacct gggcgacctc
  61 cgcggcggcg gcggcggcgg ctgggtagag tcagggccgg gggcgcacgc cggaacacct
 121 gggccgccgg gcaccgagcg tcgggggggct gcgcggcgcg accctggaga gggcgcagcc
 181 gatgcgggcg gcggcggcgg cggggggcgt gcggacggcc gcgctggcgc tgctgctggg
 241 ggcgctgcac tgggcgccgg cgcgctgcga ggagtacgac tactatggct ggcaggccga
 301 gccgctgcac ggccgctcct actccaagcc gccgcagtgc cttgacatcc ctgccgacct
 361 gccgctctgc cacacggtgg gctacaagcg catgcggctg cccaacctgc tggagcacga
 421 gagcctggcc gaagtgaagc agcaggcgag cagctggctg ccgctgctgg ccaagcgctg
 481 ccactcggat acgcaggtct tcctgtgctc gctctttgcg cccgtctgtc tcgaccggcc
 541 catctacccg tgccgctcgc tgtgcgaggc cgtgcgcgcc ggctgcgcgc gctcatgga
 601 ggcctacggc ttcccctggc ctgagatgct gcactgccac aagttccccc tggacaacga
 661 cctctgcatc gccgtgcagt tcgggcacct gcccgccacc gcgcctccag tgaccaagat
 721 ctgcgcccag tgtgagatgg agcacagtgc tgacggcctc atggagcaga tgtgctccag
 781 tgactttgtg gtcaaaatgc gcatcaagga gatcaagata gagaatgggg accggaagct
```

-continued

```
 841 gattggagcc cagaaaaaga agaagctgct caagccgggc cccctgaagc gcaaggacac 901 caagcggctg gtgctgcaca tgaagaatgg cgcgggctgc ccctgcccac agctggacag 961 cctggcgggc agcttcctgg tcatgggccg caaagtggat ggacagctgc tgctcatggc 1021 cgtctaccgc tgggacaaga agaataagga gatgaagttt gcagtcaaat tcatgttctc 1081 ctacccctgc tccctctact accctttctt ctacggggcg gcagagcccc actgaagggc 1141 actcctcctt gccctgccag ctgtgccttg cttgccctct ggcccgccc caacttccag 1201 gctgacccgg ccctactgga gggtgttttc acgaatgttg ttactggcac aaggcctaag 1261 ggatgggcac ggagcccagg ctgtcctttt tgacccaggg gtcctggggt ccctgggatg 1321 ttgggcttcc tctctcagga gcagggcttc ttcatctggg tgaagacctc agggtctcag 1381 aaagtaggca ggggaggaga gggtaaggga aaggtggagg ggctcagggc accctgaggc 1441 ggaggtttca gagtagaagg tgatgtcagc tccagctccc ctctgtcggt ggtggggcct 1501 caccttgaag agggaagtct caatattagg ctaagctatt tgggaaagtt ctccccaccg 1561 cccctgtacg cgtcatccta gcccccctta ggaaaggagt tagggtctca gtgcctccag 1621 ccacaccccc tgccttcccc agcttgccca tttccctgcc ccaaggccca gagctccccc 1681 cagactggag agcaagccca gcccagcctc ggcatagacc cccttctggt ccgcccgtgg 1741 ctcgattccc gggattcatt cctcagcctc tgcttctccc ttttatccca ataagttatt 1801 gctactgctg tgaggccata ggtactagac aaccaataca tgcagggttg ggttttctaa 1861 ttttttttaac tttttaatta aatcaaaggt cgacgcgcgg ccgcg
```

D. SEQ ID NO: 604

MRAAAAGGVRTAALALLLGALHWAPARCEEYDYYGWQAEPLHGRSYSKPPQCLDIPADLPLCHTVGYKR

MRLPNLLEHESLAEVKQQASSWLPLLAKRCHSDTQVFLCSLFAPVCLDRPIYPCRSLCEAVRAGCAPLME

AYGFPWPEMLHCHKFPLDNDLCIAVQFGHLPATAPPVTKICAQCEMEHSADGLMEQMCSSDFVVKMRIKE

IKIENGDRKLIGAQKKKKLLKPGPLKRKDTKRLVLHMKNGAGCPCPQLDSLAGSFLVMGRKVDGQLLLMA

VYRWDKKNKEMKFAVKFMFSYPCSLYYPFFYGAAEPH

The sFRP-5 gene is a member of the sFRP family, which inhibit the Wnt signal transduction pathway. Wnts are a family of paracrine/autocrine factors which affect cell growth and proliferation. Wnt ligand binds to its cell surface receptor Frizzled. Frizzled then signals through Dishevelled to inhibit the kinase activity of a complex which contains glycogen synthase kinase 3 (GSK3), Axin, β-catenin and other proteins. When the complex is phosphorylated, β-catenin is targeted for rapid degradation. When the complex is hypophosphorylated due to Wnt signaling, β-catenin is stabilized and translocates to the nucleus where it binds the TCF/LEF family of transcription factors which in turn regulate the Wnt target genes. Ross, et al. (Science 289:950-953) has shown sFRP-1 that Wnt signaling inhibits adipogenesis. Thus, Wnt signaling inhibits adipogenesis. Inhibiting sFRP-5 should modulate the Wnt-1 signaling pathway, and hence modulate adipogenesis. This evidence, in combination with sFRP-5 being a secreted protein, makes sFRP-5 a prime candidate for serving as a drug target in treating obesity.

Also included under sFRP-5 polynucleotides are a nucleotide sequence which has sufficient identity to a nucleotide sequence contained in SEQ ID NO:103 or SEQ ID NO:104 to hybridize under conditions useable for amplification or for use as a probe or marker. The invention also provides polynucleotides which are complementary to such sFRP-5 polynucleotides. In preferred embodiments, the polynucleotides are fully complementary to sFRP-5 over the entire length of the reference polynucleotide.

Mouse sFRP-5 of the present invention has a 91% identity with human sFRP-5 at the DNA level and 89% at the amino acid level. Accordingly, included in the present invention are polynucleotides encoding polypeptides which have at least 91% identity, preferably at least 92% identity, more preferably at least 93% identity, even more preferably at least 94-99% identity, to the amino acid sequence of murine sFRP-5 over the entire length of the recited amino acid sequence.

The nucleotide sequences encoding the sFRP-5 polypeptide of SEQ ID NO:603 may be identical to the polypeptide encoding sequence contained in SEQ ID NO:103 or it may be a sequence, which as a result of the redundancy (degeneracy) of the genetic code, also encodes the polypeptide of SEQ ID NO:603.

Figure 2:
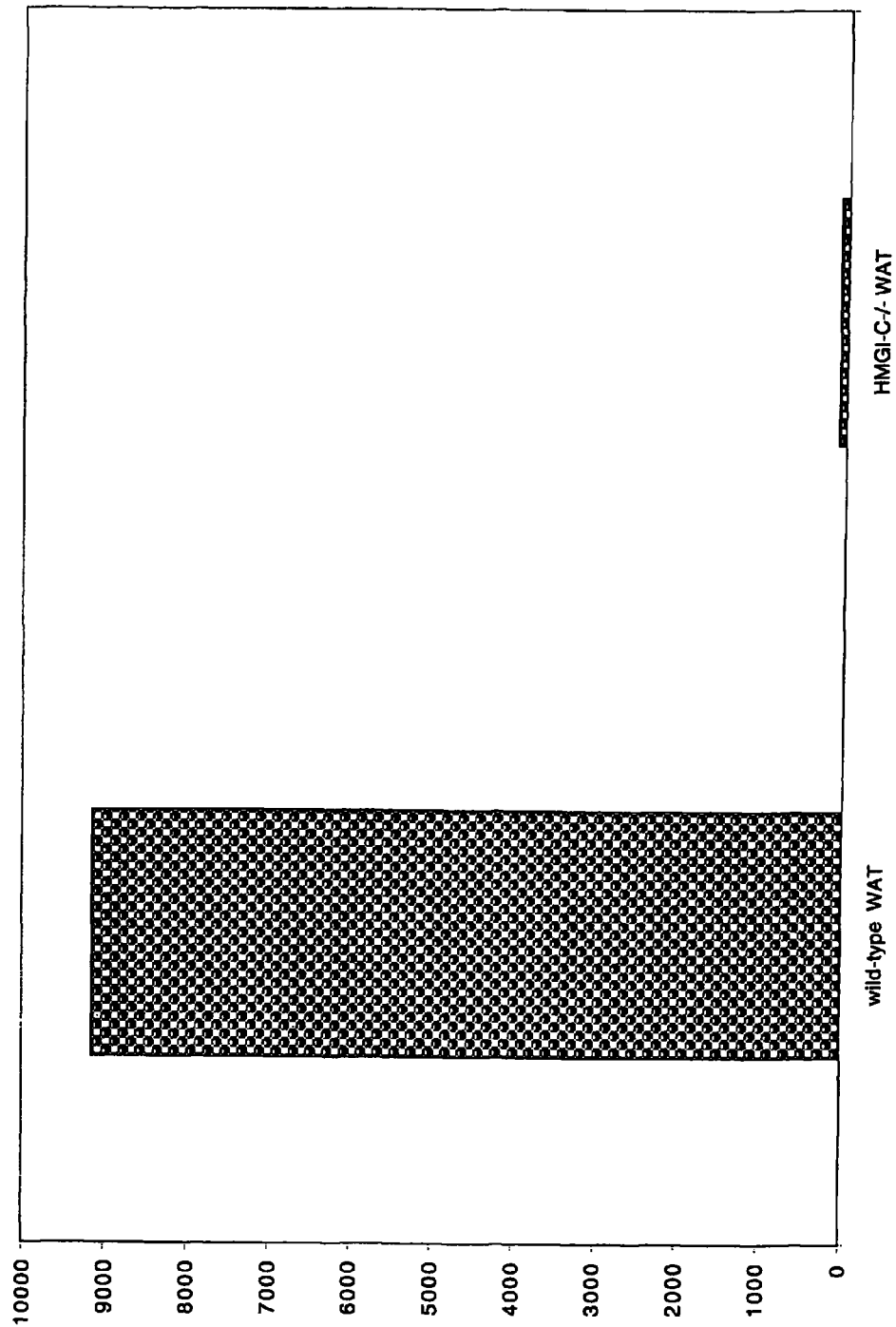
FIG. 2 represents the dependence of sFRP-5 expression on HMGI-C in the white adipose tissue (WAT) of wild-type mice versus HMGI-C −/− mice
Figure 3:
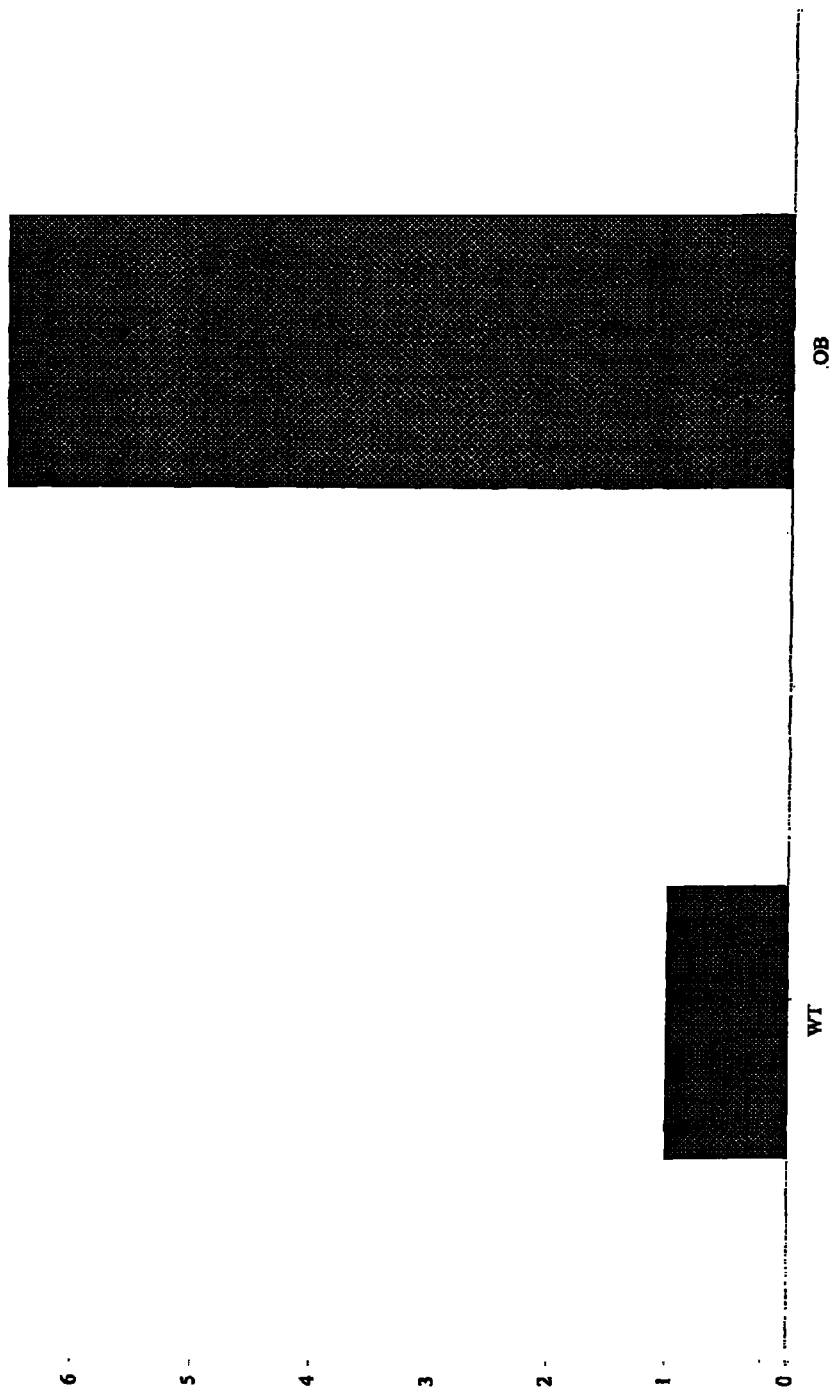
FIG. 3 represents the differential expression of sFRP-5 in the adipose of wild type versus obese mice
Figure 4:
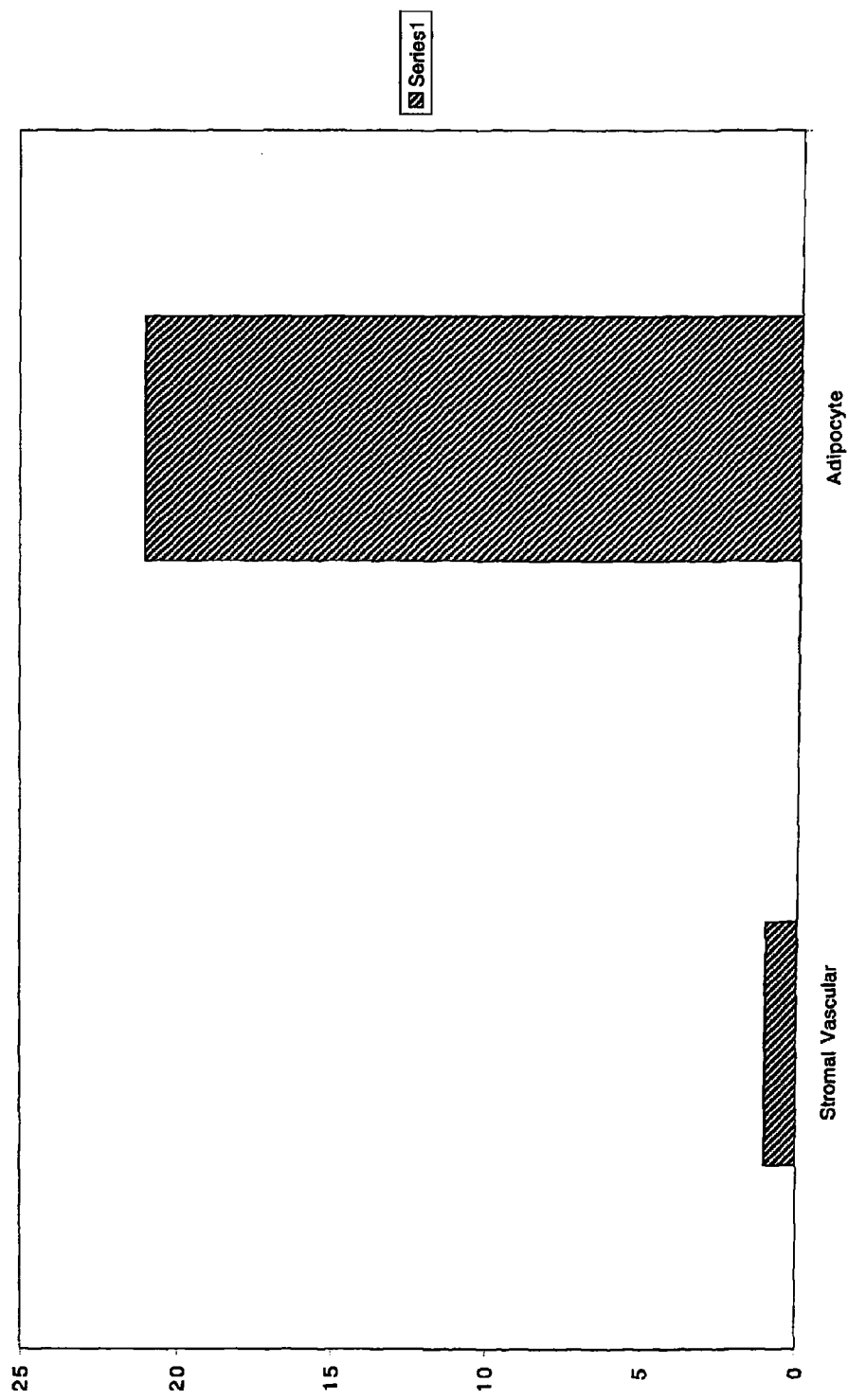
FIG. 4 represents the differential expression of sFRP-5 in cells of the stromal vascular fraction (preadipocytes) versus differentiated adipocytes.
Figure 5:
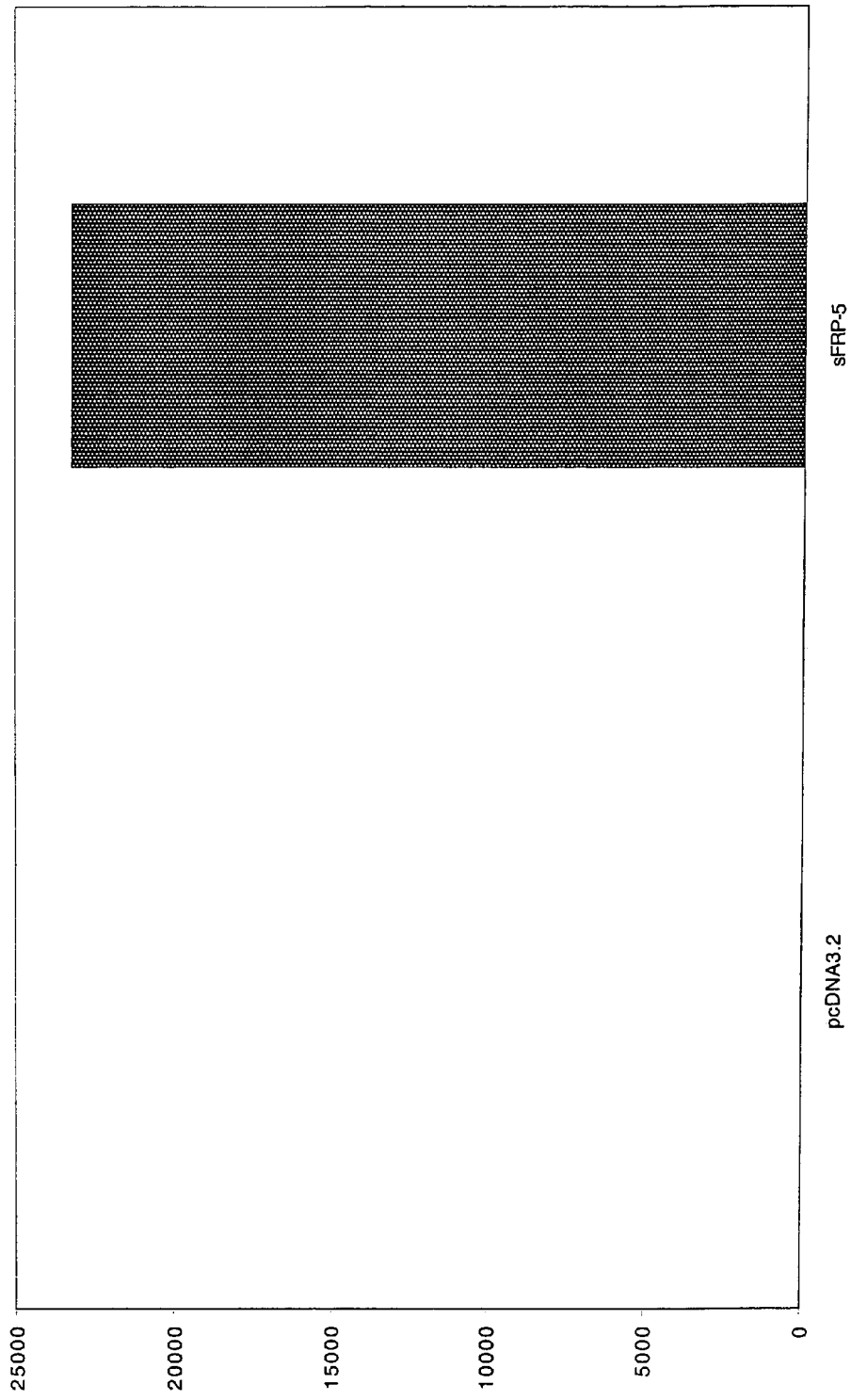
FIG. 5 represents the increased sFRP-5 expression in CHO cells harboring an sFRP-5 expression plasmid.
Figure 6:
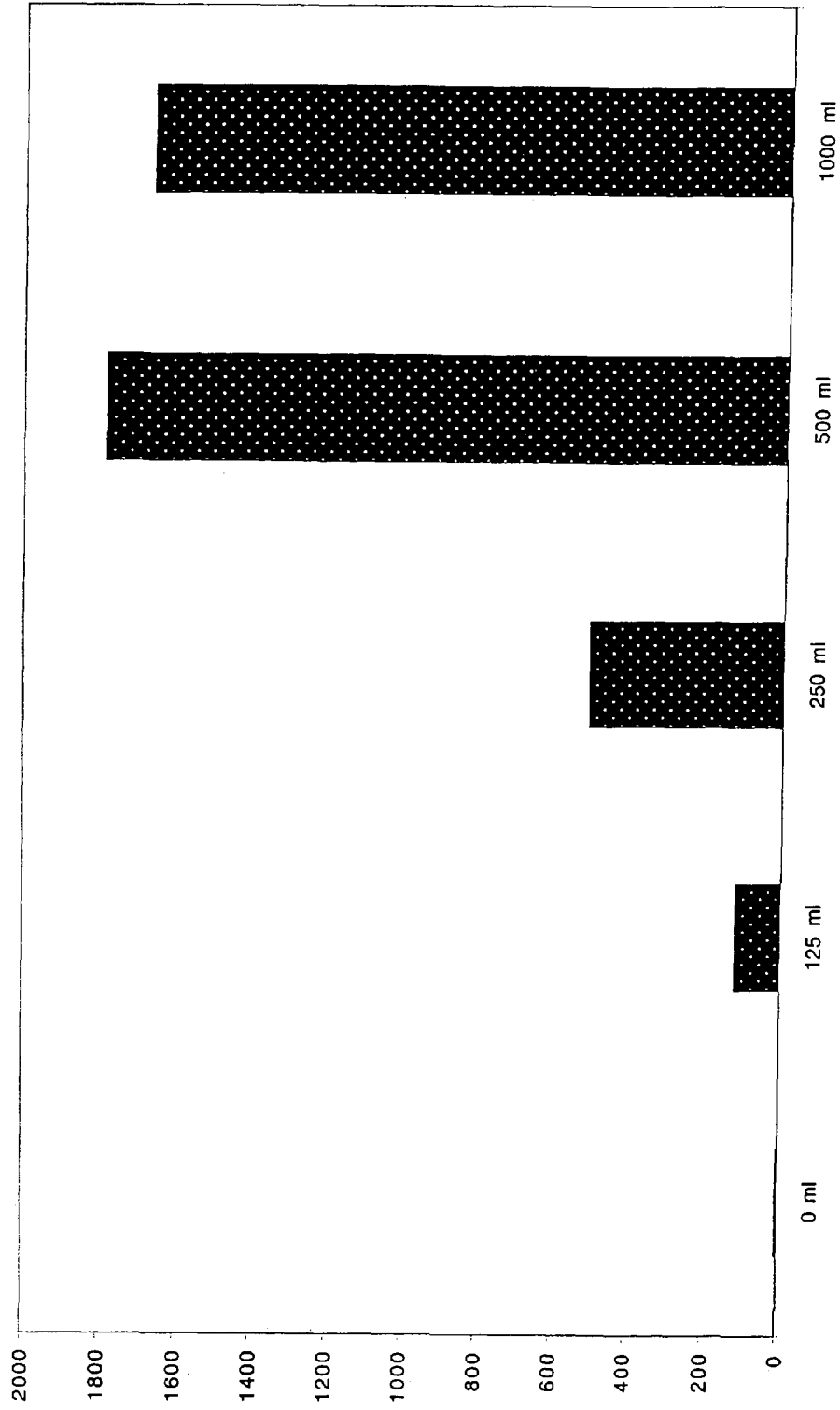
FIG. 6 represents changes sFRP-5 expression levels in response to different doses of conditioned medium containing sFRP-5.
Figure 7:
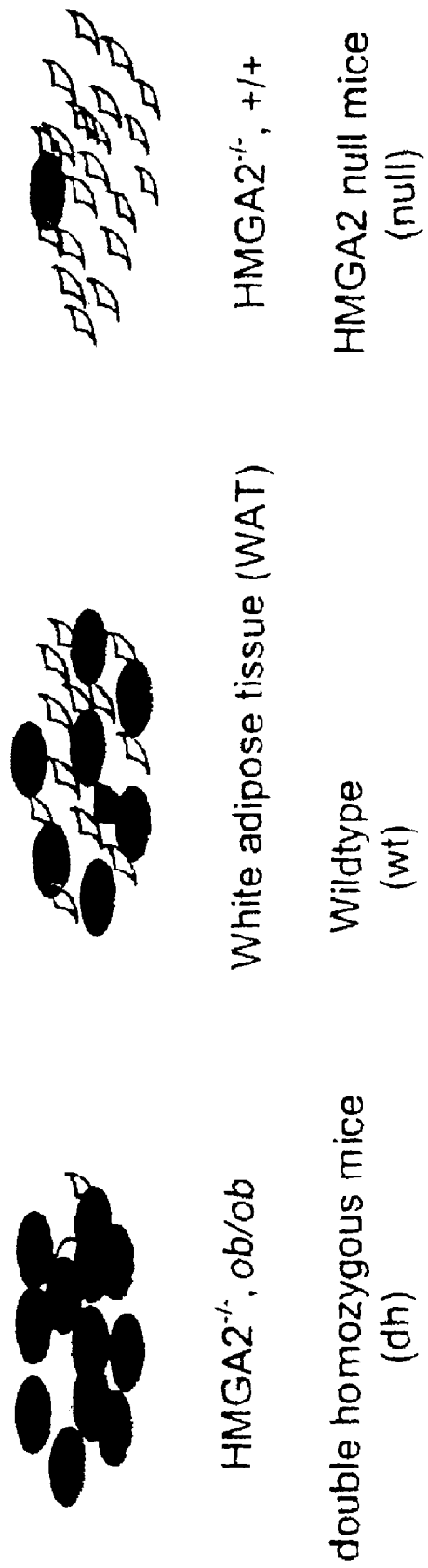
FIG. 7 A2 mice of various genotypes provide an enriched in vivo source of preadipocytes and adipocytes.

The present invention provides a novel gene sFRP-5, whose expression is upregulated in response to leptin deficiency. In leptin deficient mice, sFRP-5 expression in the adipose tissue is increased by 6.5-fold (see FIG. 2). The normal expression of sFRP-5 is HMGI-C dependent. Expression of sFRP-5 in white adipose tissue (WAT) is decreased 10-fold in the lean HMGI-C knockout mice as compared to wild-type mice (FIG. 1). sFRP-5 expression in WAT is confined to adipocyte fraction with negligible expression in the stromal vascular fraction (FIG. 3). sFRP-5 also acts in an autocrine fashion to upregulate its own expression in adipocytes. Conditioned medium from CHO cells containing sFRP-5 (FIG. 4) increases endogenous expression of sFRP-5 in 3T3-L1 adipocytes by greater than 1600-fold (FIG. 5). sFRP-5 expression in wild-type mice is most prominent in the adult fat pads (The protein of the present invention also plays a role in obesity. According to one aspect of this invention, an isolated polynucleotide capable, of upregulating its own expression is provided.

Preferably, the polynucleotide comprises a sequence selected from the following group: SEQ ID NO:103; an allelic variant of SEQ ID NO:103; a sequence hybridizing with SEQ ID NO:103 or its complement under moderate hybridization and washing conditions; a sequence encoding a polypeptide having an amino acid sequence of SEQ ID NO:603 with up to 5% conservative substitutions; SEQ ID NO:104; an allelic variant of SEQ ID NO:104; a sequence hybridizing with SEQ ID NO:104 or its complement under moderate hybridization and washing conditions; a sequence encoding a polypeptide having an amino acid sequence of SEQ ID NO:604 with up to 5% conservative substitutions.

Another aspect of the invention features a recombinant DNA molecule comprising a vector having an insert that includes part or all of an sFRP-5 polynucleotide and cells transformed with the recombinant DNA molecule. Preferably, the cells are murine or human cells. Most preferably, the cells are adipose cells from one of the aforementioned organisms.

The invention also features an isolated polypeptide produced by expression of the sFRP-5 polynucleotides described above. Antibodies immunologically specific for the protein, or one or more epitopes thereof, are also provided.

In another aspect, the invention relates to methods for using such polypeptides and polynucleotides, including the treatment of obesity, hypertension, cardiovascular disease and diabetes. The present invention is also implicated in diseases and conditions such as obesity, hypertension, cardiovascular disease and diabetes, among others. In still another aspect, the invention relates to methods to identify agonists and antagonists using the materials provided by the invention, and treating diseases or conditions associated with obesity, hypertension, cardiovascular disease and diabetes or sFRP-5 imbalance with the identified compounds. Methods of using the inventive polynucleotides and polypeptides as pharmaceutical formulations in the treatment of obese patients are also provided. Still further provided in the present invention are methods of screening individuals for predisposition to obesity using polynucleotides and polypeptides of the present invention.

The invention also provides a pharmaceutical composition, comprising one or more vectors which comprise DNA constructs comprising any of the nucleic acid sequences of SEQ ID NO: 103 and SEQ ID NO: 104

In another embodiment, the invention provides a pharmaceutical composition comprising one or more peptides encoded by any of the sequences SEQ ID NO: 103 and SEQ ID NO: 104.

In yet another embodiment, the invention provides for a pharmaceutical composition comprising an agonist to any of the peptides encoded by any of the sequences SEQ ID NO: 103 and SEQ ID NO: 104.

In still another embodiment, the invention provides for a pharmaceutical composition comprising an antagonist to any of the peptides encoded by any of the sequences SEQ ID NO: 103 and SEQ ID NO: 104.

Therefore, another aspect of the invention is a kit to diagnose or diagnose the susceptibility to a disease related to obesity in a subject which comprises:

(a) an sFRP-5 polynucleotide, preferably the nucleotide sequence of SEQ ID NO: 103 or 104; or a fragment thereof;

(b) a nucleotide sequence complementary to that of (a)

(c) an sFRP-5 polypeptide, preferably a polypeptide of SEQ ID NO: 603 or 604, or a fragment thereof; or (d) and antibody to an sFRP-5 polypeptide, preferably to the polypeptide of SEQ ID NO: 603 or 604.

In any such diagnostic kit, (a), (b), (c), or (d) may be a substantial component.

sFRP-5 Subcloning sFRP-5 cDNA was subcloned as follows. Total RNA from the ob/ob mouse was reverse transcribed using superscript II RT reverse transcriptase. A forward primer SEQ ID NO:278 (5'-CACCATGTGGGTGGCCTGGAGCGCACGG-3') and reverse primer SEQ ID NO:279 (5'-CACAGCTGGCTGGT-TGGGGCAA-3') were used to amplify the sFRP-5 coding sequence. The product was purified on a 1% agarose gel and subcloned into the pENTR/D-TOPO plasmid vector. The gene was sequenced and then transferred into the pcDNA3.2/DEST plasmid vector (Invitrogen) via in vitro recombination using the LR clonase enzyme mix (Invitrogen) as recommended by the manufacturer. The pcDNA3.2/sFRP-5 was amplified in *E. coli* and purified using the Midi plasmid isolation kit (Quiagen).

Real Time PCR Analysis of sFRP-5 Expression

Snap-frozen tissues were used to isolate total RNA by the RNeasy protocol (Qiagen Inc. CA). Briefly, tissues were homogenized in the lysis buffer containing guanidine isothiocyanate and applied to the RNeasy column. After several washes to remove contaminants, RNA bound to the column matrix is eluted in distilled water. First strand cDNA is made from 1 □g of total RNA using reverse transcriptase in a standard reaction.

Quantitative real-time PCR using the Applied Biosystems ABI Prism 7900HT sequence detector provides an accurate method for the determination of mRNA levels in a tissue sample. The quantitation is based on the detection of a fluorescent signal produced proportionally during the amplification of a PCR product (see FIG. 4, below). A probe (TaqMan) is designed to anneal to the sequence of interest between the usual forward and reverse PCR primers. The probe is labelled with a reporter fluorochrome at the 5' end and a quencher either at any T position or at the 3' end. The probe is designed to have a higher $T_m$ than the primers as the probe must be 100% annealed at the extension phase for the assay to be successful. As long as the reporter and the quencher are both attached to the probe, the quencher blocks the fluorescence of the reporter. However, as the Taq polymerase extends the primer, the intrinsic 5'-3' exonuclease activity of the Taq polymerase degrades the probe thereby releasing the reporter. The amount of fluorescence released during the amplification cycle is proportional to the amount of product generated in each cycle.

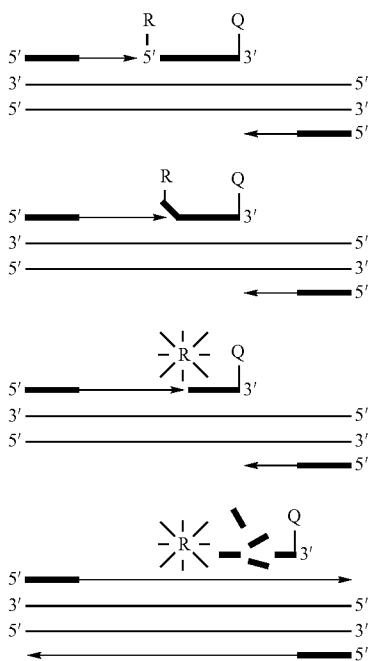

Quantitative Real-Time PCR (1) Forward and reverse primers are extended with Taq polymerase as in a normal PCR reaction. A probe containing a reporter (R) and a quencher (Q) anneals between the two primers. (2) As the polymerase extends the primer, the probe is displaced. (3) The intrinsic exonuclease activity of the polymerase cleaves the reporter from the probe. (4) After release of the reporter, a fluorescent signal is generated. Emissions are measured every six seconds by a laser/charge-coupled device (CCD) optics system.

The sensitivity of detection of this system allows for the acquisition of data while the PCR reaction is in the exponential phase. This is measured by identifying the cycle number at which the reporter signal rises above the background noise. The cycle at which this occurs is called the threshold cycle ($C_t$.) The $C_t$ is determined at the steepest part of the curve during the exponential phase of the reaction and is more reliable than end-point measurements of accumulated PCR products. The $C_t$ is inversely proportional to the copy number of the target template, thus the higher the template concentration the lower the threshold cycle measured. An example of a typical output is shown in the figure below.

Figure 8:
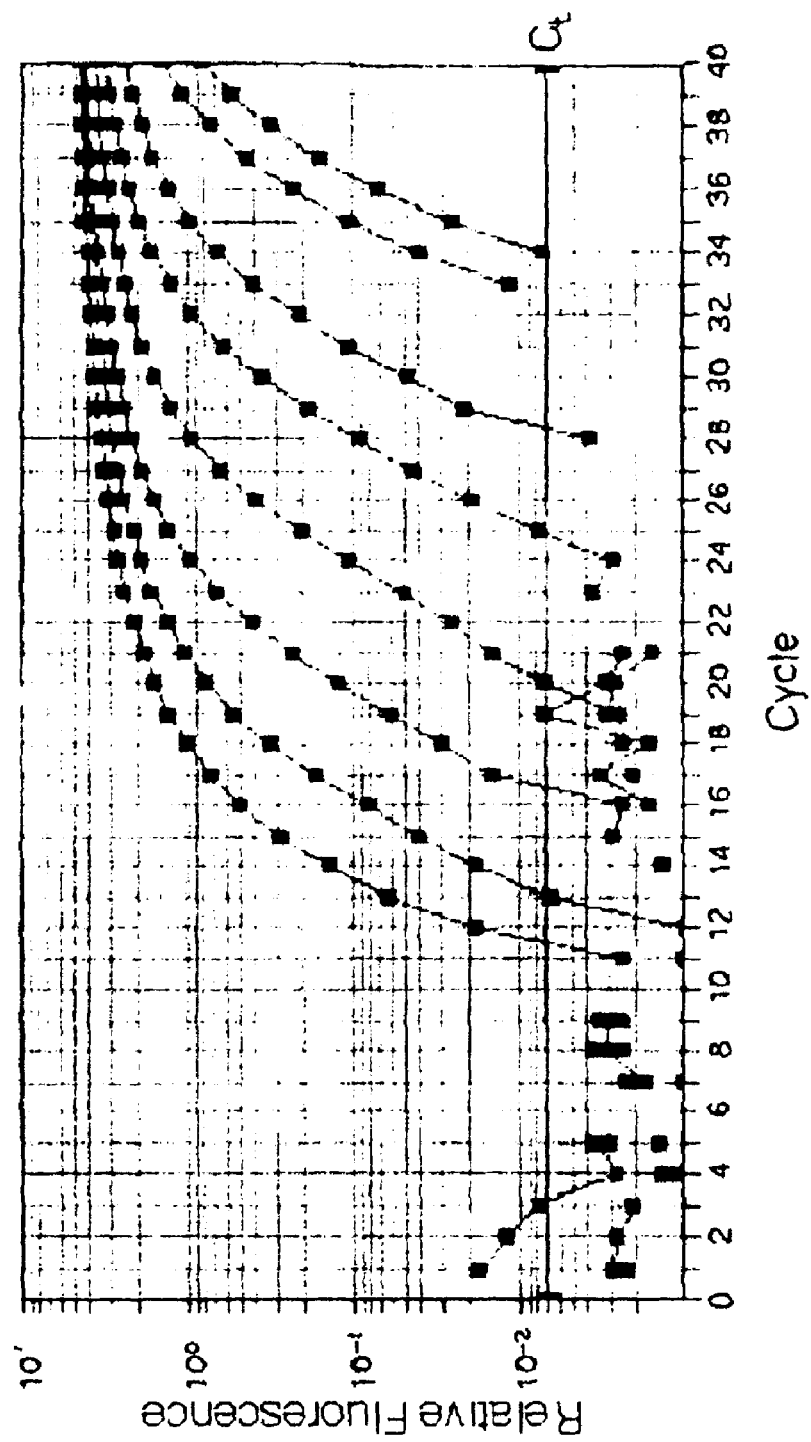
FIG. 8 This graph illustrates one of the possible outputs of the ABI Prism 7900HT. This window shows the amount of fluorescence in each amplification cycle for each reaction. The threshold cycle ($C_t$) is shown by the darker horizontal line.

The graph in FIG. 8 illustrates one of the possible outputs of the ABI Prism 7900HT. This window shows the amount of fluorescence in each amplification cycle for each reaction. The threshold cycle ($C_t$) is shown by the darker horizontal line.

One significant advantage to this system is the ability to multiplex quantitative PCR reactions. That is, up to three fluorescent dyes can be used in the same reaction, so endogenous controls can be run in the same well. For example, kits are available from Applied Biosystems for 18S ribosomal RNA or for glyceraldehyde-3-phosphate dehydrogenase (GAPDH) to be used as internal controls. In order to determine copy number, kits are available to produce cRNA in order to generate a standard curve. The cRNA must be validated in the RT-PCR reactions to ensure that it is transcribed and amplified at the same efficiency as the target mRNA present in a mixture of extracted RNAs. Other controls to be used are no-amplification controls to test for the contamination of the RNA with genomic DNA and no-template controls to ensure that the reagents are not contaminated.

The design of TaqMan probes and primers is critical to the success of the experiment. Using the Primer Design program, we have designed primers and probes for human and mouse sFRP-5 mRNAs. The parameters for effective primers and probes have been well-documented and have been built into the program. The parameters include a $T_m$ for the probe that is 10° C. higher than the primers, a primer $T_m$ between 58° C. and 60° C., an amplicon size of between 50 and 150 bases, the absence of 5' Gs and primer length.

Cell Culture

Briefly, transient expression of sFRP-5 in Chinese hamster ovary (CHO) cells was carried out as follows. CHO cells were seeded in a dish of 6 cm diameter and cultured in Ham's F12K medium adjusted to 2 mM L-glutamine and to 1.5 g/L of sodium bicarbonate and containing 10% fetal bovine serum. The cells were maintained at 37° C. in a humidified atmosphere of 5% $CO_2$. culture were grown to 90% confluence and were transfected with 8 µg pcDNA3.2/DEST-sfrp5 DNA or pcDNA3.2DEST as a negative control with Lipofectamine 2000 (Invitrogen) as recommended by the manufacturer. After 6 hours of incubation, the cells were washed with PBS and growth medium was added for incubation for 48 hours, at which point the conditioned medium containing secreted sFRP-5 was collected for further study.

Assays for sFRP-5 mRNA Expression Levels:

3T3-L1 cells were grown in 6 cm diameter plates in Dulbecco's Modified Eagle Medium (DMEM) adjusted to 4 mM L-glutamine, to 1.5 g/L of Sodium Bicarbonate, and to 4.5 g/L glucose and containing 10% fetal bovine serum. The cells were maintained at 37° C. in a humidified atmosphere of 5% $CO_2$. At full confluence the cells were supplemented with conditioned medium containing sFRP-5 in amounts described in FIG. 4. Maximal autocrine stimulation of sFRP-5 expression in 3T3-L1 cells was achieved at a dose of 500 µl conditioned medium per 5 ml of growth medium. After 6 days of incubation, the cells were collected and total RNA was isolated using the Rneasy kit (Quiagen). Random primer cDNA was synthesized using Superscript II (Invitrogen). Real time quantitative PCR (TaqMan™) for sFRP-5 and the GAPDH control was performed in the Applied biosystems ABI 7900HT Thermocycler using the recommended reagents and protocols of the manufacturer. The primers and Taq-Man™ sequences are as follows:

sFRP-5:

```
                                           SEQ ID NO: 280
    (forward)  5'-TGTGCCCAGTGTGAGATGGA-3'

SEQ ID NO: 281
    (reverse)  5'-GCGCATCTTGACCACAAAGTC-3'

SEQ ID NO: 282
    (probe)    6FAM-TGACGGCCTCATGGAACAGATGTGC-TAMRA
```

GAPDH Control:

```
                                           SEQ ID NO: 283
    (forward)  5'-CAACGGGAAGCCCATCAC-3'

SEQ ID NO: 284
    (reverse)  5'-CGGCCTCACCCCATTTG-3'

SEQ ID NO: 285
    (probe)    VIG-ATCTTCCAGGAGCGAGACCCCACTAACA-TAMRA
```

Similar experiments were conducted using conditioned medium from pcDNA3.2/DEST-sfrp5 transfected 3T3-L1 cells with substantially identical results.

Identification of npr-3 as an Adipocyte Specific Gene

The natriuretic peptide (NP) system is an important component in the regulation of sodium and water balance, blood volume and blood pressure. This system works through several mechanisms, for example decreasing renin release and consequently aldosterone release by the adrenal cortex, thereby decreasing sodium and fluid retention in the kidneys. The NP system has also been shown to inhibit vasopressin, again causing a decrease in fluid retention in the kidney. These actions contribute to reductions in blood volume, and therefore central venous pressure, cardiac output, and arterial blood pressure. A third mechanism appears to be arterial vasodilation in response to hypervolemia.

The family of natriuretic peptides includes atrial natriuretic peptide (ANP), brain natriuretic peptide (BNP) and C-type natriuretic peptide (CNP). The primary signalling molecules for these peptides are natriuretic peptide receptor A (nprA, npr1) which binds ANP and BNP, and natriuretic peptide receptor B (nprB, npr2) which binds CNP. The A and B receptors share approximately 62% identity at the amino acid level and have been classified as guanylyl cyclase receptors. That is, their intracellular domains possess a kinase-like domain and a guanylyl cyclase catalytic domain. Upon ligand binding to the extracellular ligand binding domain, the guanylyl cyclase catalytic domain is activated causing and increase in intracellular cyclic GMP (cGMP) which potentiates the physiological activity of the receptors. The A receptor has been implicated in vasodilation, increased diuresis and natriuresis, and decreased renin and aldosterone. The B receptor has been implicated in vasodilation and increased long bone growth. (for review see Levin, et al., New England Journal of Medicine 339(5): 321-328 (1998) and Potter, et al., J. Biol. Chem. 276(9): 6057-6060 (2001)).

There is a third receptor, natriuretic peptide receptor C, (nprC, npr3) which shares only approximately 32% identity with nprA and nprB over the length of the protein. The C receptor retains a similar extracellular ligand binding domain and trans-membrane domain, but has only a short intracellular domain (37 amino acid residues) which lacks both the kinase-like domain and guanylyl cyclase activation domain. ANP, BNP, and CNP all bind this receptor with approximately equal affinity. The receptor is called the "C" receptor in that it has been shown to participate in the local clearance of the natriuretic peptides. The receptor binds the ligand and is internalized. The ligand is degraded and the receptor is retroendocytozed back to the cell surface (Nussenzveig, et al., J. Biol. Chem. 265(34) 20952-20958 (1990). The C receptor accounts for approximately 50% of natriuretic peptide clearance, the other half being carried out by cell surface neutral endopeptidases. However, while nprA and nprB are often called "biologically active" receptors to the exclusion of nprC, it has been suggested that nprC has other biological activity other than simply natriuretic peptide clearance. Several groups have shown that the c-terminal domain of nprC can interact with inhibitory G-proteins ($G_i$) that act to down-regulate adenylyl cyclase and thus reduce the level of intracellular cyclic A MP (cAMP) (Palaparti, et al., Biochem. J., 346:313-320 (2000) and Pagano, et al., J. Biol. Chem. 276 (25):22064-22070 (2001)). Recently, it has been postulated that the vasodilatory effects of endothelium-derived hyperpolarizing factor (EDHF) may be attributed to such nprC mediated adenylyl cyclase inhibition (Chauhan, et al., Proc. Natl. Acad. Sci. USA, 100(3):1426-1431 (2003).

ANP and BNP have been linked to lipolysis in a cGMP dependent manner which does not depend on cAMP production or phosphodiesterase inhibition (Sengenes, et al., FASEB J.,. 14(10): 1345-51 (2000)). Thus, ANP and BNP have been implicated in the biology of the adipocyte, but not nprC. In this case, for example, the authors have attributed the lipolytic effects as being linked to cGMP production in which nprC does not participate.

Specific npr3 knockout mice were made to determine the effect of an absence of nprC on water balance, salt balance, and blood pressure (Matsukawa, et al., Proc. Natl. Acad. Sci. USA 96:7403-7408 (1999)). The animals have a moderately but statistically significantly lowered blood pressure and with age show an increase in daily water uptake with a significant increase in urinary output. The knockout mice also have a defect in the ability to concentrate their urine. The observed alterations in renal function were interpreted as being the result of a failure of local clearance of natriuretic peptides in the glomerular and post-glomerular structures resulting in an increase in filtered volume and a decrease in water reabsorption. The decrease in blood pressure was attributed to simple hypovolemia. These animals exhibit skeletal abnormalities including an overgrowth of the long bones as well as other defects. The authors note that the animals exhibit " . . . elongated femurs, tibias, metatarsal, and digital bones, longer vertebral bodies, increase body length, and decreased weight [emphasis added]." However, the authors did not account for the decrease in weight nor did they make any examination of the adipose tissue.

Several spontaneously occurring mutants in the npr3 have been identified, the first of which was called longjohn (lgj) due to the skeletal defects described above. A French group studied them to examine and compare the skeletal defects among the three strains (Jaubert, et al., Proc. Natl. Acad. Sci. USA 96:10278-10283 (1999). They note offhandedly that " . . . older mutant mice are exceptionally thin and . . . at necropsy normal body fat deposits are absent." Again, the authors do not make any more mention of the animals' weight or adipose tissue.

In light of the genetic evidence above, inhibitors to nprC should be useful to treat or prevent adipose accumulation. A group of such inhibitors has been disclosed in PCT International Publication No. WO 00/61631, the contents of which are hereby incorporated by reference. The role of nprC in adipose biology is unclear. One possibility is this: since ANP and BNP have been shown to promote lipolysis, the lack of the clearance receptor i.e. nprC causes an increased half-life of ANP and BNP and therefore results in increased lipolysis. No alterations in weight gain have been noted in patients receiving recombinant human BNP for acute congestive heart failure, but these patients receive the medication acutely as a bolus and thus there was not enough time to see an effect on adipose mass.

The Genbank accession number for the mouse npr3 gene is NM_008728 [online], Genbank. Retrieved from the Internet: <URL:

http://www.ncbi.nlm.nih.gov: 80/entrez/query.fcgi?cmd=Retrieve&db=nucleotide&list_uids=6679115&dopt=GenBank>

The peptide sequence is as follows:

(SEQ. ID. NO. 594)
MRSFLLFTFSACVLLARVLLAGGASSGAGDTRPGSRRRAREALAAQKIEV

LVLLPRDITYLFSLARVRPAIEYALRSVEGNGTGRKLLPPGTRFQVAYED

-continued

SDCGNRALFSLVDRVAAARGAKPDLILGPVCGYAAAPVARLASHWDLPML
SAGALAAGFQHKDTEYSHLTRVAPAYAKMGEMMLALFRHHHWSRAALVYS
DDKLERNCYFTLEGVHEVFQEEGLHTSAYNFDETKDLDLDDIVRYIQGSE
RVVIMCASGDTIRRIMLAVHRHGMTSGDYAFFNIELFNSSSYGDGSWRRG
DKHDSEAKQAYSSLQTVTLLRTVKPEFEKFSMEVKSSVEKQGLNEEDYVN

-continued

MFVEGFHDAILLYVLALHEVLRAGYSKKDGGKIIQQTWNRTFEGIAGQVS
IDANGDRYGDFSVVAMTDTEAGTQEVIGDYFGKEGRFQMRSNVKYPWGPL
KLRLDETRIVEHTNSSPCKSSGGLEESAVTGIVVGALLGAGLLMAFYFFR
KKYRITIERRNQQEESNIGKHRELREDSIRSHFSVA

The DNA sequence is as follows (SEQ.ID.NO. 94)
```
   1 atgcggtcct ttctgctgtt cactttctcg gcgtgcgtgc tgctggcccg ggtgctgctg
  61 gctggcggcg cgagcagcgg cgccgggac acccggccag gcagcaggcg ccgggcgaga
 121 gaggcgctgg cggctcaaaa gatcgaggtg cttgttctat tgccccggga cattacgtac
 181 ttgttctcgc tggcccgggt gaggccgcc atcgagtacg cgctgcgtag cgtggagggc
 241 aatggcaccg ggaggaagct gctgccgcca ggcactcgct tccaggtggc ctacgaagac
 301 tcggactgcg gcaaccgcgc gctcttcagt cttgtggacc gcgtggcggc ggcgcgcggc
 361 gccaagccgg atctcatcct ggggcccgtg tgcgggtacg cggcggcgcc ggtggctcgg
 421 ctggcgtctc actgggacct gccgatgctg tccgcaggag cgctggccgc cggttttcag
 481 cacaaggaca cggaatactc gcacctcacg cgcgtggcgc ctgcctacgc aagatggga
 541 gagatgatgc tcgctctgtt tcgccaccac cactggagcc gtgcagccct ggtctacagc
 601 gacgacaaac tcgagaggaa ctgttatttc accctcgagg gggtccacga ggttttcag
 661 gaggaggggt tgcacacgtc tgcctacaat ttcgacgaga ccaaagactt ggacctggac
 721 gacatagtgc gctacatcca aggcagcgag cgagtggtga tcatgtgtgc cagtggtgac
 781 accattcgga gaatcatgtt ggcggtgcac agacacggca tgaccagtgg agactacgct
 841 ttcttcaaca ttgaactctt caacagttct tcctacggag atggctcgtg gaggagagga
 901 gacaaacacg actctgaagc taaacaagca tactcgtccc tccaaacagt caccctactg
 961 aggaccgtga aacctgagtt tgagaagttt tccatggagg tgaaaagttc tgttgagaaa
1021 caagggctca atgaggagga ttacgtgaac atgtttgttg aagggttcca tgacgccatc
1081 ctcctctacg ttctggcttt acatgaagta ctcagagctg gctacagcaa gaaggatggg
1141 gggaaaatca tccagcagac ttggaacagg acatttgaag gtatcgccgg gcaggtgtcc
1201 atagatgcca acggggaccg gtatgggac ttctctgtgg ttgctatgac tgacactgaa
1261 gcaggcaccc aagaggtcat tggtgattac tttgggaaag aaggccggtt ccaaatgcga
1321 tcgaatgtca aatatccttg gggccctttg aaactgagac tagatgagac cagaatcgtg
1381 gagcatacca acagctctcc ttgcaaatca tcaggtggcc tagaagaatc tgcagtgaca
1441 ggaatcgttg tcggggccct actaggtgct ggcttgctaa tggccttcta cttttcagg
1501 aagaaataca gaataaccat tgagaggcga aatcagcaag aggaaagcaa catcgggaag
1561 catcgagagc tgcgagaaga ttccatcaga tcacattttt cggtggctta a
```

The protein sequence is as follows:

(SEQ.ID.NO. 778)
MPSLLVLTFSPCVLLGWALLAGGTGGGGVGGGGGGAGIGGGRQEREALPP
QKIEVLVLLPQDDSYLFSLTRVRPAIEYALRSVEGNGTGRRLLPPGTRFQ
VAYEDSDCGNRALFSLVDRVAAARGAKPDLILGPVCEYAAAPVARLASHW

-continued

DLPMLSAGALAAGFQHKDSEYSHLTRVAPAYAKMGEMMLALFRHHHWSRA
ALVYSDDKLERNCYFTLEGVHEVFQEEGLHTSIYSFDETKDLDLEDIVRN
IQASERVVIMCASSDTIRSIMLVAHRHGMTSGDYAFFNIELFNSSSYGDG

SWKRGDKHDFEAKQAYSSLQTVTLLRTVKPEFEKFSMEVKSSVEKQGLNM
EDYVNMFVEGFHDAILLYVLALHEVLRAGYSKKDGGKIIQQTWNRTFEGI
AGQVSIDANGDRYGDFSVIAMTDVEAGTQEVIGDYFGKEGRFEMRPNVKY
PWGPLKLRIDENRIVEHTNSSPCKSCGLEESAVTGIVVGALLGAGLLMAF
YFFRKKYRITIERRTQQEESNLGKHRELREDSIRSHFSVA

The DNA sequence is as follows:

(SEQ.ID.NO. 278)

```
   1 gggggcaga gggcgagtcg gcggcggcga gggcaagctc tttcttgcgg cacgatgccg
  61 tctctgctgg tgctcacttt ctccccgtgc gtactactcg gctgggcgtt gctggccggc
 121 ggcaccggtg gcggtggcgt tggcggcggc ggcggtggcg cgggcatagg cggcggacgc
 181 caggagagag aggcgctgcc gccacagaag atcgaggtgc tggtgttact gccccaggat
 241 gactcgtact tgttttcact cacccgggtg cggccggcca tcgagtatgc tctgcgcagc
 301 gtggagggca acgggactgg gaggcggctt ctgccgccgg cactcgctt ccaggtggct
 361 tacgaggatt cagactgtgg gaaccgtgcg ctcttcagct tggtgaccg cgtggcggcg
 421 gcgcggggcg ccaagccaga ccttatcctg gggccagtgt gcgagtatgc agcagcgcca
 481 gtgcccggc ttgcatcgca ctgggacctg cccatgctgt cggctggggc gctggccgct
 541 ggcttccagc acaaggactc tgagtactcg cacctcacgc gcgtggcgcc cgcctacgcc
 601 aagatgggcg agatgatgct cgccctgttc cgccaccacc actggagccg cgctgcactg
 661 gtctacagcg acgacaagct ggagcggaac tgctacttca ccctcgaggg ggtccacgag
 721 gtcttccagg aggagggttt gcacacgtcc atctacagtt tcgacgagac caaagacttg
 781 gatctggaag acatcgtgcg caatatccag gccagtgaga gagtggtgat catgtgtgcg
 841 agcagtgaca ccatccggag catcatgctg gtggcgcaca ggcatggcat gaccagtgga
 901 gactacgcct tcttcaacat tgagctcttc aacagctctt cctatggaga tggctcatgg
 961 aagagaggag acaaacacga ctttgaagct aagcaagcat actcgtccct ccagacagtc
1021 actctactga ggacagtgaa acctgagttt gagaagtttt ccatggaggt gaaaagttca
1081 gttgagaaac aagggctcaa tatggaggat tacgttaaca tgtttgttga aggattccac
1141 gatgccatcc tcctctacgt cttggctcta catgaagtac tcagagctgg ttacagcaaa
1201 aaggatggag ggaaaattat acagcagact tggaacagaa catttgaagg tatcgccggg
1261 caggtgtcca tagatgccaa cggagaccga tatggggatt tctctgtgat tgccatgact
1321 gatgtggagg cgggcaccca ggaggttatt ggtgattatt ttggaaaaga aggtcgtttt
1381 gaaatgcggc cgaatgtcaa atatccttgg ggccctttaa aactgagaat agatgaaaac
1441 cgaattgtag agcatacaaa cagctctccc tgcaaatcat gtggcctaga agaatcggca
1501 gtgacaggaa ttgtcgtggg ggctttacta ggagctggct tgctaatggc cttctacttt
1561 ttcaggaaga aatacagaat aaccattgag aggcgaaccc agcaagaaga aagtaacctt
1621 ggaaaacatc gggaattacg ggaagattcc atcagatccc attttcagt agcttaaagg
1681 aagccccca cttttttttt tctgcctgag attctttaag gagatagacg ggttgaaaga
1741 catcaatgaa ac
```

SEQUENCE LISTING (750 sequences)

SEQ ID NO: 1 - DNA, 5774 bp, Mus musculus
catatctaaagggattgggcgcccagacgctgccagcagcggtcctgctctgagggaccctttaccctgactggtccaggtgactcgagctgctgtgtcacccagagactgccacctccagccccacaggctgccatcatgtcagcttcaggagatgggaccagggtcccccccaaatccaaaggcaagaccttgagcagtttctttgggtccctgcctggcttcagctctgcccggaacctggtgtcccacactcacagctccacctccacaaaggacttacaaacagcaacagacccctcggggactcctgccccctcatctaaagtgtccaccaactcacagatggcaggggatgcagcagggctgctccaaccttctgaacagacagctggagacaaggacatgggaagtttcagtgtgaccagcagtgaagatgccttctctggggtgtttggcatcatggatgctgcaaaaggaatggtccagggtggactgggtgctacccagtcggcccttgtcggaactaaggaggcagtatctggaggtgtgatgggagcagtgggcgtggccaaaggtcttgtcaagggaggtcttgacacttcaaagaatgtcctcaccaatacgaaggacacagttaccacaggagtcatgggagctgcaaacatggccaaagggacagtacagacaggcctggacaccaccaagtctgtggtcatgggcactaaggacacagtggccacaggacttgcaggggctgtgaatgtggctaaaggcaccatccagggtggcctggacaccaccaagtctgtggtcatgggcactaaggacacggtgaccacaggactcacaggggctgcgaacgtggctaaaggtgttgtccagggtggcctggacactaccaagtctgtggtcatgggcaccaaggacacagtaaccacaggactcacaggggccatgaatgtggctaaaggcacagcgcagatgggtatagacaccagcaagactgtgctgactggcacaaaggacactgtatgtgctggggccacaggagccattaatgtagctaaaggggctgcccaaggaggcctggacaccaccaagtctgtgctcataggcaccaaggatacggtgaccacagggctcacaggggctgtgaacgtggctaaaggtgctgtccagggaggcctggacactaccaagtctgtggtcatgggcaccaaggacacggtaaccacaggactcactggggccatgaatgtggctaaaggcacagcacagatgggtcttggcaccagcaagactgtgctgactggcacaaaggacactgtatgtgctgggctcacaggagccattaatgtggctaaaggggctgcccaaggaggcctggacaccaccaagtctgtgctcatgggtacaaaggacacagtgaccacagggctcacaggggctgtgaacgtggctaaaggtaccatccagggtggcctggacaccaccaagtctgtggtcatgggcactaaggacacggtgaccacagggctcacaggggctgtgaacgtggctaaaggtaccatccagggtggcctggacaccaccaagtctgtggtcatgggcactaaggacacggtgaccacaggactcacaggggctgtgaacgtggctaaaggtgctgcccagggaggcctggacactaccaagtctgtggtcatgggcaccaaggacacagtaaccacaggactcacaggggccatgaatgtggctaaaggcacagcacagatgggtcttggcaccagcaagactgtgctgactggcacaaaggacactgtatgtgctgggctcacaggagccattaatgtggctaaaggggctgcccaaggaggcctggacaccaccaagtctgtgctcatgggtacaaaggacacagtgaccacagggctcacaggggctgtgaacgtggctaaaggtaccatccagggtggcctggacaccaccaagtctgtggtcatgggcactaaggacacggtgaccacaggactcacaggggctgtgaacgtggctaaaggtgctgtccagggtggcctggacactaccaaatctgtggtcatgggcaccaaggacacagtaaccacaggactcacaggggccttgaatgtggctaaaggcacagcacagatgggtatagacaccagcaagactgtgctgattggcacaaaggacactgtatgtgctggggccacaggagccattaacatggctaaaggggctgcccaaggaggcctggacactaccaagtccgtgctcatgggtacaaaggacacggtgaccacaggactcacaggggccattaacgtggctaaagggtctgcccaaggaggcctggacaccaccaagtctgtgctcattggtacgaaggacacggtgaccacagggctcacaggagccttgaatgtggccaaaggaacagtacagacaggtctggatactagccagagagtgctgacaggcacaaaggacaatgtatatgctggggtcactggtgcagtaaatgtggccaaaggtaccatccagggcggcttggacaccaccaagtctgtggtcatgggcactaaggacacggtgaccacaggactcacaggggctgtgaacgtggctaaaggtgctgtccagggtggcctggacactaccaaatctgtggtcatgggcaccaaggacacagtaaccacaggactcacaggggccatgaatgtggctaaaggcacagcacagatgggtatagacaccagcaagactgtgctgactggcacaaaggacactgtatgtgctgggctcacaggagccattaatgtagctaaaggggctacccaaggaggcctggacaccaccaagtctgtgctcatgggtacaaaggacacggtgaccacaggactcacaggtgccattaatgttgccaaaggggctgcccaaggaggcctggataccaccaagtctgtgctcttaggtaccaaggacaccgtgaccacggggctcacaggggcagcaaatgtggccaaagaaacagtgcaaatgggtctggataccagcaagaacatcctgatggacacaaaggactctatatgtgctggggccacaggagccattactgtggtcaaaggggctgctcaaggaggcctggatacttcgaacgcagcactcacaggcacaatggacacggccaaaggaacagtgcaaacaagcctggacaccagcaagcatatgcttataggcatgaaggacactgtctgtgctggggttaccagtgccatgaacatggctaaaggtattcataagaacacagacaccaccagagacacccagtcttctgtgctggctcattcaggtaatgtagccaccaatgccatccacacaggtgttcacacagttccgagttcactctctggctctcattccatcatctgtcatgagcctagcatttacagagccactaaccatggggtaggacatgccatcctgacttctacagagtccctgtgctgtgagacaagcagcttctcagacaaatatggcttggggcatgtcacagagcccagagctgacaccaaaacccttgtgtctggtatggcttcatctgcctgcgcagctaccaggtcagtggaggagtgtggtcagctggctgccacaggctttgctgcacttcctgatgagttgaaagggctgggtgatatctttcagcccatgacaactgaggaacaagctcagctggcagtctcagagtcagggccccgagtactctctgctgaccggggaagctactacatccgtctgggtgacctggcccctagcttccgccagcgggccttcgaacatgccctgagccacatacagcacaaccagttccaagccagggctgcagtagcccagctccaggaggccttccagatgacagacatgaccatggaggctgcatgtgggaagctgtgcagtgaccagagcttgaacaccatggtggaggctgttggtagccatgagatgcgggcttccgtggctcaggacaggctgtgcaccctcgcccatcagctccatgcagcttacagcagcctagtaaccagcctgcagggcctgccagaggtgcagcagcaggcagggcaggcacggcacagcctctgcaagctgtatggccttgtgtcttcggaggcaggtagtgagctgcagacagagcagctggcccagagcagtgctggtgttgttgaggcctggcagggcctggaggtgctgcttgagaagctgcagcagaaccctccactcagctggctggttggacccttcacctcgatgccttgtggccagctgtaggcacctgagggctgggtgggtggggtcccagggaccatgctgtgaccacagctggctgtacttccccaaagctctggattgaacaggagcagaagatcctcggaaagtgaatttgaaaccagccacagctcctgctatttctaagaaccaatgatcccttccctccaaactagccaccaagtctgttcagatacaggccacacagacccccacacagagtaaagaagcatcacgcgtccccactggccagctttctatccttggggctctgacagtctttccagggcccatagctcttctctacgagtggtgtcactccagcccaggccctactctgggcagcacaaccacagatcttagctaatgactatgtccttgttccctgggactagaatgcacagccatgctgatgtaggctcctacagccgcttctgctacttactagggagaaatgctgcacaaaaccacacaattacattccaggctgctataggcctgactcaggcctgctctgctgagaaaacgagagtcatatatatatcactgcatggaaacagggttgatctgacaggcccagcactgctgagtagctgtggcctgtacaggaacatggcctgcagcctagggttgaagactgtactgaatggggatatgggcagttgatggttcttctcccttgccttgccctacgcacccaagatagaagcaaacaagatgctggggcacaaggcactgactcaccaccaggccaaggccacagcccagccctccctgaaccccagcagtactagtgaccccaatcttccagcccctttatctcttggaaaataacaatgtccacaagctttaggcctgggccagctgtggccaaggaatgccatgatagagacggcaaggagcctttccctgaccttctgccatgtcagcatcagggtgacactagacccagccactggcaaacactgggctcagagcctgcagctaagctttccaacagatggcatgagcctcattacatcatgccaagttattggtggctattgaggcgggtggatacaaccaggaggcatgtacccaactcgtgagcccactgggaacacagaagagtggggaagcccctgctgaaagctacagtgagagggggttggggtggtgtggactgcaacactccagcccagaggccgagctgccccagaggcactttgctggtcccacctgggggtccctgcacagctagtgatggatttctgttgggttgtccttagtgtctgcttcactcaagctggtagaacaggctactcgctgcactaagagttctgccagcctgtgggtatgagacctgccctgaatcaggtctggctccctatactgctcatggtagccagcacctaagccaataaaagctgtttctttttcatgcttga

SEQ ID NO: 2 - DNA, 1413 bp, Homo sapiens
atggcagaacaaaccttcagttctgctttttcagctgctcagtttgcagaaaccaagggcactgccgttctccgagtgctcaagggcactgccgttctccacgtgctcacgggcaccaccgttctccatgtactaaagggcaccgccgttctccacgtgctcaagggcaccgccattctccaggtgctcacgggcactgctgttctccatgtactaaagggcaccgccgttctccacgtactaaagggcactgccgttctccaggtgcttacgggcactgccgtcctccacgtactaaagggcactgccgttctccacgtgctcacgggcaccaccgttctccatgtactaaagggcaccgccgttctccacgtgctcaagggcaccgccattctccaggtgctcacgggcaccgccgttctccacgtactaaagggcaccgccgttctccacgtgctcaagggcactgccgttctccaggtgctcacgggcactgctgttctccatgtactaaagggcaccgccgttctccacgtgctcacgggcactgccgttctccatgtactaaagggcactgcagttcgctgcatgctcaagggcaccgccgttctccatatactaaagggcaccgccgttctccacgtactaaagggcactgccgttctccacgtgctcaagggcaccgccgttctccacgtgctcacgggcactgctgttctccatgtactaaagggcaccgccgttctccaggtgctcacgggcactgccattctccatgtactaaagggcactgccgttctccatgtactaaagggcactgcagttcgctgcatgctcaagggcaccgccgttctccatatactaaagggcaccgctgttctccaggtgctcacgggcactgctgttctccatgtactaaagggcactgccgttctccacgtgctcaagggcaccgctgttctccaggtgctcacgggcactgccgttctccaggtgctcaagggcaccgccgttctccatgtactaaagggcactgcagttctccacgtgctcaagggcaccgccgttctccaggtgctcacaggcactgccgttctccatgtactaaagggcaccgccgttctccatgtactaaagggcactgcagttcgctgcatgctcaagggcactgctgctctccactcgttcaaggtcaccgcagctctccacggcttaacggcaccaccggtctccacgtgcagccagggcaccaccactctccacccgctcaaggtcaccgctgctctccacactcaaggcactcaggacagccaccgttggtccttcttctctctccggggcaaggccaaggcccccccgatcctggggccctggagcacctggagcaccgtgcagtgtgagctttgtctctga

SEQ ID NO: 3 - DNA, 1320 bp, Homo sapiens
atgaccgtatactgctgtaggctttatacacactgcacacgcaggctgctccggcttctgggaggacggtcaggggccctggcctggagctggaagagggtgcaggacacacacagggtgcagccagggcaccgccgctcactgcgcgctcatgggcactgccacttctcacctctaaagggcactgccgttctccgagtgctcaagggcactgccgttctccacgtgctcacgggcaccaccgttctccatgtactaaagggcaccgccgttctccacgtgctcaagggcaccgccattctccaggtgctcacgggcaccgccgttctccacgtgctcaagggcaccgtcgttctccacgtactaaagggcaccgccgttctccacatgctcaagggcactgccgttctccaggtgctcacgggcactgctgttctccatgtactaaagggcaccgccgttctccacgtactaaagggcactgccgttctccaggtgctcacgggcactgccgttctccatgtactaaagggcactgcagttcgctgcatgctcaagggcaccgccgttctccatatactaaagggcaccgccgttctccacgtactaaagggcactgccgttctccacgtgctcaagggcaccgccgttctccaggtgctcacgggcactgccattctccatgtactaaagggcactgccgttctccatgtactaaagggcactgcagttcgctgcatgctcaagggcaccgccgttctccatatactaaagggcaccgctgttctccaggtgctcacgggcactgctgttctccatgtactaaagggcactgccgttctccacgtgctcaagggcaccgctgttctccaggtgctcacgggcactgccgttctccaggtgctcaagggcaccgccgttctccatgtactaaagggcactgcagttctccacgtgctcaagggcaccgccgttctccaggtgctcacgggcactgccgttctccatgtactaaagggcaccgccgttctccatgtactaaagggcactgcagttcgctgcatgctcaagggcactgctgctctccactcgttcaaggtcaccgcagctctccacggcttaacggcaccaccggtctccacgtgcagccagggcaccaccactctccacccgctcaaggtcaccgctgctctccacactcaaggcactcaggacagccaccgttggtccttcttctctctccggggcaaggccaaggcccccccgatcctggggccctggagcacctggagcaccgtgcagtgtgagctttgtctctga

SEQ ID NO: 4 - DNA, 995 bp, Mus musculus
gcggccatggttccgaaagtggcagcagcctcggcagaactgctcatcatcggctggtacatcttccgcgtgctgctgcaggtgttcaggtactccctgcagaagctggcgcacacggtgtcccggaccgggcggcaggtgctgggggagcgcaggcagcgagcccccaactgaggccccagctcccagccctgggcggccgtgtcatcaggtgctcctgtgcttctcgaccagcatgggagccagtgccgcgcaggaatggggggtcccctgtgttccctcgtcagaggagcacttgccaaggtcagtgaggggccggtaggccccccagaaaagcagcaccgacaatgatgaagatatcagttcccttcccagcccctttgcccctgtcccactaccggcgggtgggagaggaggggggaagaggggagcaaccctcgagatatgggcgtaggcaccacattctgatctggaccaagtcggaacagcaccatctcagccgcacaagatcctaccatgaagatcgaacagcccatcaaccagcagaatggacattctgacatcaccagctgaagccctacatctcggtgggtggtggaggaagagggttaagaaaactagtggggcccccttgctgccccttgcctatggcacacatattcctgccttgctccctcatttccccttttccccccgccttcgaaagccctccccaaaatgtgtcacttgatttggatatattcaaccagtaattgaatcccacctttaccaaaacacgttctctaacccccggcccttcactgatcttgcttatccctggtctcacgcagcagttgtggtcaatattgtggtagtcgctaattgtactggtttaagtgtgcattagtagtgtctccccagctagattgtaagctcctggagacagggaccacctccaccaaaaataaaaaaatggacctctcctgtcttgtagtgtcctaggaccctgcagggca

SEQ ID NO: 5 - DNA, 1300 bp, Homo sapiens
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcacc

SEQ ID NO: 6 - DNA, 1102 bp, Mus musculus
gcggactccgagaccagtagacctcggcgaacccttgctctcgaccacccacccactttcggaaccatggccgcagtggcagcagcctcggcagaactgctcatcatcggctggtacatcttccgcgtgctgctgcaggtgttcaggtactccctgcagaagctggcgcacacggtgtcccggaccgggcggcaggtgctgggggagcgcaggcagcgagcccccaactgaggccccagctcccagccctgggcggccgtgtcatcaggtgctcctgtgcttctcgaccagcatgggagccagtgccgcgcaggaatggggggtcccctgtgttccctcgtcagaggagcacttgccaaggtcagtgaggggccggtaggccccccagaaaagcagcaccgacaatgatgaagatatcagttcccttcccagcccctttgcccctgtcccactaccggcgggtgggagaggaggggggaagaggggagcaaccctcgagatatgggcgtaggcaccacattctgatctggaccaagtcggaacagcaccatctcagccgcacaagatcctaccatgaagatcgaacagcccatcaaccagcagaatggacattctgacatcaccagctgaagccctacatctcggtgcagaagagaaagtgtcaactgtgtgcagcatggggggagtggagggcgtgggtggtggaggaagagggttaagaaaactagtggggcccccttgctgccccttgcctatggcacacatattcctgccttgctccctcatttccccttttccccccgccttcgaaagccctccccaaaatgtgtcacttgatttggatatattcaaccagtaattgaatcccacctttaccaaaacacgttctctaacccccggcccttcactgatcttgcttatccctggtctcacgcagcagttgtggtcaatattgtggtagtcgctaattgtactggtttaagtgtgcattagtagtgtctccccagctagattgtaagctcctggagacagggaccacctccaccaaaaataaaaaaatggacctctcctgtcttgtagtgtcctaggaccctgcagggca

SEQ ID NO: 7 - DNA, 1158 bp, Homo sapiens
cagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagcctgggcggccgtatatagtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagaccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcacccaccgcgtgcctgtgtggcgggactggagggcacagttgaggaaggagggtggttaagaaatacagtggggccctctcgctgtcccttgcccagggcacttgtattccagcctcgctgcatttgctctctcgattgcccctttcctcctacatgcctcccaagcccaccctactccaaaagtaatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtctctccccagctagattgtaagctcctggaggacagggaccacctctacaaaaaataaaaaaagtacctcccctgtctcgcacagtgtcccaggaccctgcggtgcagtagaggcgca

SEQ ID NO: 8 - DNA, 1183 bp, Mus musculus
gcggactccgagaccagtagacctcggcgaacccttgctctcgaccacccacccactttcggaaccatggccgcagtggcagcagcctcggcagaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcgcacacggtgtcccggaccgggcggcaggtgctgggggagcgcaggcagcgagcccccaactgaggccccagctcccagccctgggcggccgtgtcatcaggtgctcctgtgcttctcgaccagcatgggagccagtgccgcgcaggaatggggggtcccctgtgttccctcgtcagaggagcacttgccaaggtcagtgaggggccggtaggccccccagaaaagcagcaccgacaatgatgaagatatcagttcccttcccagcccctttgcccctgtcccactaccggcgggtgggagaggaggggggaagaggggagcaaccctcgagatatgggcgtaggcaccacattctgatctggaccaagtcggaacagcaccatctcagccgcacaagatcctaccatgaagatcgaacagcccatcaaccagcagaatggacattctgacatcaccagctgaagccctacatctcggtgcagaagagaaagtgtcaactgtgtgcagcatggggggagtggagggcgtgggtggtggaggaagagggttaagaaaactagtggggcccccttgctgccccttgcctatggcacacatattcctgccttgctccctcatttccccttttccccccgccttcgaaagccctccccaaaatgtgtcacttgatttggatatattcaaccagtaattgaatcccacctttaccaaaacacgttctctaacccccggcccttcactgatcttgcttatccctggtctcacgcagcagttgtggtcaatattgtggtagtcgctaattgtactggtttaagtgtgcattagtagtgtctccccagctagattgtaagctcctggagacagggaccacctccaccaaaaataaaaaaatggacctctcctgtcttgtagtgtcctaggaccctgcagggca

SEQ ID NO: 9 - DNA, 1300 bp, Homo sapiens; identical to SEQ ID NO: 5

SEQ ID NO: 10 - DNA, 14357 bp, Mus musculus
ctcgatctccattttacacttggggaaactgaggaaggcaggggagatggggtaggaagtcttggcatgtgcacattgcacactatacttgtgcttgcttgcttggtttcttttttttttttttttttttttttttttggtgagggtagaggaggtcaggaaaaataagactaacatagtggcaatagattctagtctgacctgtgtactgtgaatctccaattggaaaattcttttcaacagctctggtcattagagagccagctaccagttactaggtttatagtgtgagcatcatggtcacatttaagggaaccaaatgtctgaagcctcaagaatgtgatgaactgtgttggatgatgtagggtttggatgcagtgggatttaagaagctcctgggtgatggaaagctatgaatcatacttttgaaagaggctgtcactagtgtcccctgtgctgagggctggagtcctagaactgggaggagcctacagggactgtgggaggggcttgagttttccaggtcagttcaagacaaatctctcatagtcggtagtgtttccgtcagcatgtgtgctcttccgtgtattgagcagagccataaaacaacattagttatatttgctgtagacatttagagagtgggaatcagaagcaaactgttctaaggcctactgggtaggctgatgttagtagaacctttggcaagagcagaaacattttgtatttagccatatgtggctgccaagcagctagctagctagcttgctttattatttatttatttaaggctgtaacatttcgtatctagccttatgtggcttccaagcggtttgtttgtttgcttatttgtttgtttatttatttgaggctgggtttcactctatattaaacagactttggactccctcttatttatttacctgtctatttatttactttaagacagagtctccttgtttagccctgatcaccttggagctctctatgtagatcagtttggccttgactttgcagtcatctcctgcccctgcctcccaagggctgggattgcaggtatgtacaattatccctagcaatactgagctctttaagggcaactactgtgattggagaaccacatttttaatacacatagccacacatgcctgatggttatcctattgaaatatggtaggttgaaaaaaaccaggctagcacttgctcaggctcacgtctctgagcacaggtgttccctgctgcctttggccagaccagtgctataggcaacccagggatcctgtctcaacaacctcacctgatgtagaactctccctttccttaacctgacaggtttgaaaaactgggtgatagctgaagatgcggtctttaagcctgtagcagccccctggaacccagagcttcagctacagcgcccacagctgaccaggcaggtcctgagcagagaggacctggctgcatttccctgggggagccctcttcctcgatacctttacctggctaccaaccagaccaatgcctggggtcaccagcgagggtaccgaatccagatccacagccctcctggtgtgcatgtgcctctggagagcagcgaggagagggctctcagctgggggaggtgaggagggcccagagaacgggggtaagggaagacctgtccccttcagcactcacacatcctggacctgccttccaattcaaaaggataactggatgggaaatggtatcaatctgatccaagggattctaggcttgtaaagcgctttggttttttttcccccaacactgcctttctacaattcctggccaggtaccagcttgtggtgacccagaggaaggaggcagagcctcacagcagcagcatctattaccagaacgacatgcggagcccagctacggtttttgctgacttcatcaacaatgaaaccctcttaggggaggttggtgggtttagagataatggggaaagccatctcttcctgatgtcttggctgtccggcctctgtccaatacaggttatccctactaggcagaaattagtcacagcagtggcaccctgcccaggttattagatattcggtgtaggaatgtggctggcagatgcagaagccaggctgaggctggaggctgggaaatggcagctaagaggtgattcttagcctcccattcttctcttctcctacaggatctggtggcttgggtgacagccagtttcctgcacatcccccatgctgaggacatccccaacacagtgactgtgggaaacagagtgggcttcttgctccgaccctacaatttcttcaatgaagatccctctatcttctcccctggcagcgtgtactttgagagggaccaggatgccgggctctgcagcatcaaccctgtggcctgcacccaacagctggcagactgtgtccccaacttaccctccttttcctatgaaggcttataggcctgaggctatggtgaggccccagggtaggagggatggaatgtggagtggagaaatggctcagcgattaagagcacttgactgttcttccagaggtcctgagttcaattccctgcaaccacatggtggctcacaaccatctgtaatgggatctgatgctctcttctggtgtgtctgaagacagagacagtgtacccatatacataaaataaatcttttaaaaaattttaaaaaaagaatggaatgtacacactcctctgttctgttcctgaattttgttttttgtctttttgtttttgtttttcaagacagggtctctctgtatagccctggctgtcctggaactcactttgtagaccaggctggcctcaaactcagaaatccgcctgcctctgcctcccaagtgctgagattaaaggtgtgtgccaccaccatctggctctgttcctgtatttttaccccacccccacccccccaccccccgcccccaggttcccatcctctgttccttagcagcctttctgcactaaagacctgggtatccctgtgggctaattcttgcttcctgcctgtcttttgtatctgtttctatttgagacagggtctttctgtgtggccctagctgtcctggaacttgctatgagttcaaggctggctttaactcacagagatctgcctacctctgcctccagactactgggattaaagatatacactactacccctggcttctgccattgaaatgataatttataaaaaatgttttggaatactcaaacaccacaagttctatcacttcaaaactcactggtgttcacaacatcaaatcaggcttcttacgtgtgtgtatctaaaaggagttacgtggttatgtacaagacggtctgccaaatttttattcgagtttattctgcttggctttttaaagtatgtagaactttatcccaggagaatatcaaggactctggccaaggaaattagtaacagtaagagccacaaggcggggctgggagggtaggtagacctggccaaggaatctttctttgaaaagaggttggaagtgggggtttccttggcaggacaatacttcacactgaatgtaaaggaaacacccggccttcataaggtgggagttgggggagaagttagtctgtggggcagacccggctactttttggcagtggatttccatacacagacgagatccctcccccttcccccaaccccagctctcccccaatcccaaccctgacccagagagcactctgatttggaaactggaggacaaagccatgtaaggtctgtggatatcactgcagccagctcagacccgcctcccaaccctagctccggcttccctgctccttcccaccctggcaaaagcagactacaaagaagctctgctattgcctagcgcctgggagaccccagccaaaaggagtccatttctggtagaagcctgtccatcaagaagcaatgacccagaagaccaccctagtactcctggctctggctgtcatcaccatctttgctttggtttgtgtcttgctagctggcaggagcggagatgggggtggactgagccaacctcttcattgcccctctgttcttcctagtgtccagccccggacacaccctagccagagccagccgtttgcagacctgagcccagaggagctgacagctgtgatgagcttcctgaccaagcacctggggccagggctggtggatgcagcccaggctcgaccctcggacaactgtgtcttctcagtagagttgcagctgcctgccaaggctgcagccctggcccacttggacagaggggggcccccacctgtgagagaggcattggccatcatcttctttggtggacaacccaagcccaacgtgagtgagctggtggtggggcccctgcctcacccctcctacatgcgggatgtgactgtggagcgccacggcggccccctgccctattaccggcgtcctgtgttggacagagagtatcaggatatcgaggagatgatcttccacagagagctgccccaagcttctggactcctccatcactgttgcttctacaaacaccagggacagaacctgctaacaatgactacagccccccgtggtttgcaatcaggggaccgggccacctggtttggcttgtattacaatctctcaggggctgggttttaccctcaccccattggcttggagcttctgatagatcataaggccctggatcctgccctgtggaccatccagaaggtattctatcaaggccgttactatgagagtctcactcagctggaggaccagtttgaggctggcctggtgaatgtggtattggtcccaaacaatggtacaggtgggtcctggtctctaaagtcctcagtgccaccgggcccagctccccctctgcagttccatccccagggaccccggttcagtgtccaggggagccaagtgtcttcttccttgtgggctttttcttttggccttggagctttcagtggcccaaggatctttgatatccgctttcaaggggagagggtggcctatgaaatcagtgtccaggaggccatagccctctacggtggaaattccccagcatcaatgtcgacctgctacgtggacggtagctttggcattggcaaatactctacccccctgatccgaggggtagactgtccttacctcgccacctatgtggactggcacttccttctggaatctcaggcccccaagacactacgtgatgcattttgtgtgtttgaacagaaccagggcctcccactccggcggcaccactcagatttctactcccattattttgggggtgttgtggggacggtgcttgtggtcagatccgtgtctaccttgctcaattacgactacatatgggacatggtcttccaccccaatggggccatagaagtcaaattccacgccacaggctatatcagctcagctttcttcttcggtgctggtgagaagtttgggaaccgagttggggcgcacacgctgggcacggtacacacccacagcgctcacttcaaagtggatctggatgtggcaggtgagacatcattgtaggttgctcaccaaacaaagattggggtagggggctatgctttccttcagtctggctgggaaaggaggggctgctgagtttcatttggatcttagcttcctgcaaagctgccagactctatacatgtgacctccttacaacatcttgggaaatggctaaccccggggagaaggctaggtccctggggtttatgtaggcctccgttcaagcaagcagttgcttgctttccaactcagctctgtctggcctgtggtacagcactggaagacattttggctctgcagagtccctgtgcatgcaagtcagtcttggaagaagtattgttctccatttccttgggagagaatctctcttcttccctgatctctttctgggcaccgttcacttcagggcagggtacctggatatggtggagagcagagagttacagatggctgctggggtttgtgattacagagacagccaaggctctgagatttcctgaagatcatttctctcttttttcttccctacattgagccatcacctagttggggttttgtttgtttgttttctattctgactatgaaatctctcaaaactctcagtaggtcacagtgttaccctctgtccctgttaggccacttttttttttttcttttttttttttctttttttttttttttaaggattttcgagacagggtttctctgtgtagccctggctgtcctggaatttactctgcagatcaggctggcctcaaactcacagagatctatatgccctcttctgcctccaacgtcaaagggattaaagatgtgcgccaccactgcctagccatagaccatcccagatgctctcagttccagggtccactgtgtacagagagctgtcccacacatgctagcatgctgttttcacgttccacagctgctgacttcccaacacctgcaggatgtcatctccagaaggtctttccttctgccagctctagcctaccctgagagcttttctagtgcactgcggtggcactgtggtagcactgtggtagcagtatcaacatgctcccaggtcctggacacacagcccatggcatctcttttttaacatgggcttcactcctaactagaatggccttccaggacttgtcttcataatatcctttaagggtaaacagaaatggtgtcttaggagttggggaggtcctgtcctgtggggcaggaacagggtcccacgtccgctccgggctagggttactgggcaaggcaggactcagaaagttttgactgtgcacacccctggaaccgccaggtggacgttgggctgtgagaagctgcaggaccccgctccggggttgggaaaagatgcaatctgggggtgcctgtggaactgctggagttgggctccaactcttgggcaccatgggcaccactgggttccatggaagagccagttttgggatccctgggctgctcggaggccagggatgtcaggttctccctctcgaacgccactgtatgtcatggaagagctgagaacagagtgggggccttcgggcagtctctggcctgggggctgaagggaaaggggcagggagtagagagctcaggcgggttacttcggagatgagagtgctaggctccttggggcagccggcttagtggtgagcaccttggctggctggctggctggtggcggtggtgcagggaggcctcccgctgggaggttagacatgcaactcattaggggaagacctgttccattgctccagcatggcggatcccaatgagcagagatggtccatggttttaaggcatttattgtagaaaggcagagagagggagagattagggaagtagaggccagccatagccacgtggagagagggaggaagggaaggcggagaaaggtggtagaagggaacaagagtaagagcaagaaaataagaagggtggggggaagagcaagtagctccttttatagtgggctggggtatcctggctgttgcccggtaactgtgggggttgagtccagacagattaccaggagcttggggcattgcctatgtgactgatggccacacacatctctgcagggggctgtgggaggcgtagctgcagctgcgacaggagcctggggcccaggaggtgtggccgaacagctgtcttcccttaaggtcaccagggtcaccagggttccaggcctgtgctcaaatgaaaaccaggctatctgagcacagctcacagccccacactatccctgcctgtgctatattcctggaatgctgtccctgtctcaccgaggcctcctcaccatgcaggcctaggctgtgtcttctctgacccctgtgcctatgagagcctgaggggagggagggaatttattcagctctgttctcagggacaaagacaggttactccaagaaagaaagatggatggagccaggcatggtggcatacgcctttaatcccagcactcaggaggcagaagcaggcggatttctgagttcgagaccagcctggtctacaaagtgagttcccagacagccccagggctatacagagaaacccctgtctcaaaaaaaaaaaaaaaaaaaaaaaaaaaaagtaataaaaataatgattgaattacatctcagagccttttcctttaaaaaaaaattttatttttggccagacagtgatgacacacacctttgattccagcactcaggaggcagaggcaggcagatctctgagtttgaggccagcctgctttacagtgtgaattgcaggactgccagggctacacaaacaaaccctgtctcaaaacaaaaacagaaggatttatttttcacttttacttgcgtgtctgtatgtatgtgcgcatcagttgtgcaggccactgggaacagaggtgttggaccctcctggagctggagttcacaagctagagcctgtgagtggcccagcgtgggttctggggcatgatcccagcccggtggaagaacagtaggtactctttttgtttggttgtttggttgtttggttacaatttataggttaatagttttgcctaaaggattggggagatcttcggactgggagggaagcaaagaacacagtctttggtctcactctgcagtcaggtagatggcagaaattcccacagtggtggaatgactagagcttacacactttacacagggctgaagaactgggcctgggcagaggatatggcttttgtccccacgattgtaccttggcaaccggagtaccagatgcagaggctgcaggtgactcggaagctgctggagacagaggaggaggctgccttcccactggggggcgccaccccacgctacctgtacctggccagtaaccacagcaacaagtggggtcataggcggggctaccgcatccagatactcagctttgctggaaagcccttgccccaggaaagtcccatagagaaagccttcacctgggggaggtgagtggtgagtgatcagagggcgtggggaagtgagcagcacatggtctgagcaggagcgagggagggatacttagaaacagttcaattgtctctgtggatgctggggttggggtaaggatgtcatttccccttggagaactaaagccaggaaagaactctttcccgttcagggctgtggggtgtgggttgtaccatgaaatggcgggggtgtgacatggccctccaggatggtgatgggaattctactactctgtgaggagctatgaaagctggggtcagagcatttagcctgcttccatcatgcagcttagagacaatggagacctaaccagtgctcttctaggtatcacttggctgtgacccagaggaaggaggaggagcctagcagctctagcatcttcaaccagaacgacccgtggacccccactgtgaacttcaccgacttcatcagcaatgagaccattgctggagaggtgagctgatggtgggatgggcagaaatggaccgccatgatgagcttcgctttctcacgggtgggtccccgaaagccatcggaactccacagaggcggagctgactccttgccttttatactttagcagatgtgaccatttcctttagcgcagtggttctcagccttcttaaaacttcgatcctttaatacagctcctcatgttgggctgacccaccccccccaaccataaaattatttggttgttacttcataaccgtaattttgctactgttatgaattataatgtaaatatctgatagccaagatatctaacatgccatcctgtggagtcaagacccttgggctgggaaccagtgttctagactcttctcgagtagagaagtcatgtgcaaacaactgcatccttcagacctatagccctcaaagtgccagctttggaaattgaatccttttcaggcctgaggattcatacagggctggaagttattagagaaaaccacagaccacagttcccatctctgccttgatgggtgtattatccttctaagtcttggccatccctgttccacaattctctgtgttatactttaaggactcttagagaatgagggaaggaaagccgaagtggcctgtagtgagcgccctcttgggtgggtgggtgaaaggtgttgtaatgggaagcacgagagatggagatgcaagccagcctccctcggggagacagtggttgtttccaatatgcaatgagcttttaatgtttatccttctgggacatccaaaagagacactgtttaaaaagattcaagatctatggtcttgtgaatagcttcttccctgggaggcggctgtgtagagagggtgtgtctggccaacctcaccatcctcatttcctctctcctgctaggacttggtagcctgggtgacggctggctttttgcacatccctcatgcagaagatatccccaacacggtgactgcggggaactcagtgggcttcttcctccggccgtataacttctttgacgaggacccctcctttcattctgctgactccatctatttccgggagggccaggatgccacggcctgtgaggttaaccccttggcttgcctgtcccagactgccacctgtgcccccgaaattcctgccttctcccatgggggctttgcttacagagacaattgaactgtttctaagtatccctccctcgctcctgctcagaccatgtgctcacttccccacgccattaagtgtccccaagatggacaatctagctaagagctgggaagtagcgcaacagccgggcagtacacagagcaattcgattgaagatctggttccttctgtccccacatctttgatgtcccctctctcttctgctgccctccttgtctctccctctctgcttggagcatcctgagcccatggaaacctgatgcacagggacactgaactttgttggttgtgcctgtactgagttcctgccttgggagaatagccttgttggagcctggagtaatggctatgttttgttttgctttgaatatggctccttttccccacccccaccgcaccccctatttggctttcatttaaaagcttatgatagctttgaggactctgcaatgaggataactctctagagacccccaaagtagggtctctctgagtctctcacatccacagattcttcatctacatccctttcctacttaagcctctttcatttccattctctccctctccctccccgccccctctcctttcctccctcccccctccctcccctcttcctggagttcctgcttgctcatacatgctaggattcctactcagtccaaaagcgatgtccgtcctaagagttctctgagccctcattctcaaactgcagtctcttctcctggacccgagtctgtggaaatctcaaagatgtaatgcaaagcctcatgggagaggaccaggcttttctatctcctaacgttcgtcacatatcaggaaggagtagggcttgtccctgcggtagccctgctttgccctctttacaagaagatggaggtgctatgattatgacgaatggttattttattctatggctctgctccactaatggctctggtctctgtgcagtagcctgcaggagccagctcgggacagtgagataggatggggtctgcccaatcagaagcaggcatgcaaatgagcctgagtctgatctgccttggtgggacctgtttcagggtttctctttgctgcttgtctttgctgagacctggacaggggctggtacacacatgactcaaaacaacagatacatcattccctagcagtctggccagccccgttgttaactaatgttattactgtagttaatggaagaaaggctggaaagatgtgtgtgcactgttcttgcaaggggcccaaattccgttcccagcatccttattaaggtgctcacaacaatctataactctatctccaggagagccggtgccctcttcaggggcacctaaacttaatgcacataccttcacacagacacatacatataaatacaaaataaaagaactcagcctggcacggtgacacatgactttaatcccagcattggaagtcagaggtagacagatctctgagcatgagtccagcctggtctacagagtgagttccaggacagccatagctatacagagaaaccctgtcttgcaaaacaaaaacaaacaaaccaaaagagagttctttaaagacaaaagaaaagctaaaaatgagtaggcgataagtgtacatttgtttatttctgctgcattccttgagaactgagtaagaccagttacctctgaggaggaagacagctgagagggaatcaggttctgcctgcccttctgaacatcatggattggaaccatgtgatcatattgccccgtcaaaataaataagtgggctatacactaactgtcttgtctttccttttaaacatgctgtgtgtggcttgcctgtgttcttgagacctagaaaagtaggtagcctgccatacagtccttgtctttcctttcttgtataaattcggaagcaatagcttcctccatccccattctttctctcgaaggagggaataatgagaagcaatggaaatgggggcttctgattggccagatgcccaggctaaaccaagaggtgaagtggcagaaacagtgttgggtgctgctcagtttctgaccagagaggcgacaacattcaagagatcagacacctggaacatttccctgacttctctctgtccaatctaatgttctcctagaggttgatgtggaaccatggttggggggcgggggggggtagtcagtgagcggaaagaaagcagactccaaagatcaagggggaactcttcagtaaggagcagggctaacagtggctggcttcatttataacatggtctggggtgggtagagaaggataaaggacaagcagatgctgcagtgaggtgggagccaaagggcatgtgcgctcagttgtgagttctgacttcactacaccacatccttccaacctaaagaattcaagtctcctttatatgcccatctttttgttcccaccaggactggctagttttatgtcaaccctacataagctagaatcgttggagcctcgattaagaaaatgtctccataagactaggctgtaggcaagcctttaggacattttcttaatttgtgacttataggggagagcccactgagggtggtaccattactgggctgggtctgtaagaaaggctgagcaagccgtgggaagcaagccagcaagcagcacccctccatggcctctgcatcagctcctgcctccaggtcctgctctgtttgcgttcctgtcctgacttccttttatgaggggctgtgctgtgaacctgtgagccaaaaaaaaaaaaaaatcattccctctccaggttgttttttttttttttttttttttttttaaaagatttatttatttatttattatatgtaagtacactgtagctgtcttcaaacactccaaaaaagggcgtcaaatctcgttacggatggttgtgacccaccatgtggttgctgggatttgaacttcggaccttcggaaaagcagtcgggtgctcttacccactgagccatctcaccagcccttgtttttggttttgaccctgatgtttcatcacagcaatgttatccctaataaagacaccgttcttttttggccccttctcaaagctggtggcagcatctgggctggtgagaaaggaaacagaggaacactacttgccatcaccaagttcacttgaaactcattcccatgatgcccagctctagactatgtggtagtatggatatgtatgtatgagcaaacacacagttcgaaaatgtgatctgtgtgtctatgtctcactaccttcctgagctcactgatagtggtgggggtggtgggagcagacatctaggtcattggaacctcagcccaactcaagccaggagggttgcaatgagactccagtttcgccgggcttggtggcacacgcctttgatcccagcactcaggaggcagaggcaggtggacttctgagttggaggtcagcctggtctacaaagtgagttccaggacagccagggctacacagagaaaccctgtctcaaaaaaacaaaaaacaaacaaacaaaaaagactccagtttcctgccgtatctggtctcttctgtagaccactgccattgtctatagtgttggccttagattcatcagatagcaaggagtgaagagcaagaggagtttgacatcctggtggattgaatgaaccaagcaacgttcagagctttaggatggaggcctgtggtcctgggaggaagctgggcaaggggatcgag

SEQ ID NO: 11 - DNA, 2501 bp, Homo sapiens
gccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactacc

SEQ ID NO: 12 - DNA, 1725 bp, Mus musculus
gtgcctggccacgcggtattgccaggaggctgggaggtgagggggaggtccaacacaatccaactgacaaggatggactacgccatgaagtctctcagcctcctgtaccccaggtcgctgtccaggcatgtggcagtgagcacggcagtggtgacccaacagctggtgtctaagcccagccgggagaccccgagggccaggccctgtcgtgttagcaccgcagatcggaaggttcgcaaaggcatcatggctcacagcttggaggacctcctgaacaaggtccaggacatcttgaaacttaaagacaagcccttctccctggtgctggaggaagatggcacaatcgtggagacagaagaatacttccaagccctggcaaaagataccatgttcatggtcctgctgaaggggcagaagtggaagcccccatcagaacagcgcaagaagagagcccagctagccctttcccagaagccaactaagaagatcgatgtggcccgggtaaccttcgacctgtacaagctgaaccctcaggactttattggctgcctgaacgtgaaggcaaccctctatgacacatactcgctttcctatgacctgcactgctacaaggccaagcgcatcgtgaaggagatcgtccgctggaccctcttcagcatgcaggccaccggtcacatgctgcttggcacctccagctacatgcagcagttcctggatgccaccgaggaagaacagcctgccaaggccaagccctcctccctcctcccagcctgtctgaagatgctgcaatgaagacccgagtcctcagaggccttccttgggccatggatgtgaccggggaccctgcgctcggctagcagcacccatgagcctggcagccagacagcttctcacctgcctgcgcctccctcacagcacagcaccaaggaaattgcaggaagggctggagccctggggtgggctggtcacaggaggacttcctagcctggcccagttccttcctttctgtctcaggtagcttagaggactaacacttagccctggcaggcacaaagtctgcccctgtgtccacttgtgccgtcttccgtgccactccctctctggtgcaccccaccatccccggtcctggctgcccacactcatcatgcagtagacattattatggtggcccccatcataccttggcctgaatcaagacaaccaagcgagcagcatgccacagcaccaactatgtctatgaccatggtgccagagtggttagcactctgtagtagaagaaaaggaggtgggggcttcgggggtctctcacctgggactctgatcactccctcctagcccccagctgcacatgatcatgaggtgtgcgagagagtgttagaggtggagattaactaaagccggcatgccagggatgcagatctggggggtcctcacctgtgccagggatgcagatctggggggtcctcacctgtgccagggagggaccttagggaatgcagatgattctgagtcacccaggcccctcctgtaagtaacctaaaagctcatagattcaccaagctggacttgggtgaaaccgcggcttagcctctcattgcctgaatggacacagttcctgttctcctgggaaaggcatgcagctgcctctcttgttctcatttttccacgaatgagtgaatggtattagagtctgcagtaaactatttatgctgaaaaaaaaaaaaa

SEQ ID NO: 13 - DNA, 1128 bp, Homo sapiens
agtatttccaggaggctgtgagggggaggtccaacgcagtccagctgacaaggatggaatacgccatgaagtcccttagccttctctaccccaagtccctctccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtggccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14 - DNA, 367 bp, Mus musculus
ggcgaccgtggtcccttggccccagtaagcaaaccccccgtcgtaatcccatctcatacagaaatacgtagccgtgtcctcatttttgaggttgcttatctgtaaatatgcagtgctggcagaggtttccaaagagaaggcaaagcgtcccttgaactcttctgcatactttggcactccagagtgggtgtttatccagccaatccacttcaaaccctttcctggcatcttttgcacccactgcattccagcagttgtgaaggtatatccagaagccttgcaggagatcctgactgtctctccaggcttcttcagttcaggtcctgactgctgcagtttcacctgggccatggccggctgggccgca

SEQ ID NO: 15 - DNA, 5428 bp, Mus musculus
tctagaaataagttagtcctggttacaagattccctaacactttagacttttaaaagcctttctcccagccttagctggtccccagcagtgcgcgccttcctgcggctcagcctttgtgtccgagctgctacccgctttctctccctaaccagttctgcgttccacgccatttcaaccgcatcccgccctttaccacccaagttattcctagtcacctcgagcaagaaggatttccctgggcctggactggaattgcttttgtggttgagagctttcaccgactttcctcccctccagggcttaaccgtgccctcccctcccccccccctcttgttccttgtgggtagactgttccccggccttcagaatgagatccattgtggggcactcaatccattaattagaaaattgccttcatcttagatgctggtgcttcggcctggtgagaatgaaagtggaattgtttgtaaggctcaaaggttccattgacagcgaatatgaaaatagataatgcagaggctttccatgcgggaacttgttaagatcagaatggctttactctgtagaaaacaccagtgcaaattttgctaagtaattcagtctttaaaaggtttggttgttagttaatataggtaggtaatcctctacttgtaaaggggtgaatttaaattgcggtcttacaggatttaaacatccgtagcttctcatttaggacacattccacattccttctgatgaactactctttctggtctgccctccaccccacctctccgcccccagcccccagtcggcgctggcgcccaaaggaaacacttttttttttttttttaaagaaaaaaaccaaaggttacggtgcagagcccccgggtgcttggcgaaagccgtcccctcgggctggaatgttctttgtctctggtaaatgtctattcatcactcaagacaaccccttcctccctccccttaattacttcctcccctgtgcgccctcaaattcttgaacttattcatgcggtatttgttaggggcctgctttgttgcccaccccatggcgggatctgggatacaaaaggttaatgagacatggtttcagactttgagggtcttaggctgagaaagaagggcccgacatgacagaaaatattctgaaatcaaaaagaaaatgtaaaaaagtgccacccttcgatccctcattcacttcacaatcttgtgcatcgcctgcggaggctccacacaagcatttgtttcctgcggtccccgaagaagtataccctggaccgcattacgtgttctgatgaccctctctcaggtgctggcattttcagtgtcagctgggtggtcacgaactccccgaacatgggaagatacccacaggttagatcccccaagggttcgactgacccattgcagttctctggcccaatcttgatcgactgcacggttgggcttggacattgcaaagccaaagctgcagcaaaccaggctccgaagagaggctgcagcgcccccgctgggccagcctgcgttcgcagcatccttagcttgcccgtgcctaggctgctagaatttcagggaacggttccaaacctcacacaggcatcacgatgctccgcactttgcgaaggtgtgaaagatgacttttaagggatttgggattaaaaaaaaatctacagttttgtccgcactctagggtgtttgcactgtgattgtgttgcacgtaaaggaggcttgtgcccccaatgaacggtccccaacgctgctccagaagggcgctgcagcagcttctggcatgtggaccacgttgtgctgcggcaaaggaagtgtaccggtgccaccgtggtggtgactttggcccattctatgtgatcgcagcctgtccatgaatgtgtccacttagccactgataccagagaatttgtccattccctagccatttagtgtgcccttccttctttgttatcatgggctaagggcttggggttgccgcgcattggtgacccgaatttttagatgcgtactcactcttagggctcaaaacacacgtaggaggtagaaaagaagtgggtgccgcaacaagaaccccagctttggggtgttttatgtcttccagggtctagggaccagtgcgtggtccaagggatatgttggggagggactctctcagacgtttgtcatccttgcccgcggcattaacacatgggaaggctttcttcactagaatctggggttcaggattagagatctataaggaaagagggggtagcgggtcaatacccctggaggcgcccacgggaaaggccccccctctctgcagcggtggggaggggctctgcggcgggagcgagaaggaggggcgctgcggcaggatgggcgggttagaggcggggctcagtgggctttaaaagtcggtgcctgcttgctcctctctgcttcggccaccagcacatcccggtgcttcttctcaggcgcagcagctttcctctgcggcagccgcacctcgccaaacggcgtagtgctgcaggctcgcccgagttgctgcttgctgcctctgctgccgctgccgcgggccgccctgcgcggaccgtaggctgcgcagacgccacctccgatcctgtatcgctgcgggcgcctcggcgcgccctgtgatccgcaatcctgcggcgggcggcatgggataatgcggccatggtgcgccgagatcgcttgcgcaggtgggtgctgccagcccgtgccgccagagggggtgtggccggcccgcaccccggagatgcgggaggcaaaaatccttatccaaaggttgccgcccagcccaaactctcggaatcgccctcactgatgatttttagaaccagggtttagtcgcgtgagatttacgaatttgaggatttttgcattaacatgtgagaattagcctttttttgtctgggtcttcgttgtggtacgatttaggaggtggtggtgaagcaacttaggattcgagaaccttggtaatgcctggtgtgttctaggatcttcagagctggtcattgttgtggcgtgatttaagatttctagaccacggcatgtgatttaggaattcaggagctgagattgtcacagagcgacttaaaatttccaggttctggactcacaatggcagggttaccgcataggtgcgactagatccgtgccgcgcagtgttggccacggctataagttgttggtttggggagcccagaaatggaaacccgggggacaccggcacgcggccaggctcttaaaatgtaaaaagaattgtttgctttggtttgtgggtgcacagcgtatgttctcaataagaatgagtcaggtgggctggtttggtgagtattagataaatatgtttttacatcatttaaagcagtaagaaatcaaggcacgtaaagtttgttgtgcgagtgtgttgaatttttgctctaaatcatggtaccatcaaatattagagagtggacttaaaaattattgtttaaaccttttggtccgattgctagtttccttgactgctaaaaatcttaaaatgtttggggtatttttaccaaggtaactaaagctgagaatggctgggggggggttgtccccctttcctgcatggaggaggtgcactgaggtatggtccggagagcgtgggtgtggcacctctgtttccctgcgccagcaggaagcccctgttcactctgcagtaggcgcccctccccggcgttctgctgagtcactgcggattcagtgagtccagcaaggatgccccagaggctacatgaaaatgtatgaacaggtaacaggaccaaatgggttctgaggaaatgagcagtaacaacaaaaagacccccccctcccccaaacctaatgcttttgcttttcaaagaggttcagccttaaaacccgttagtggataacagactgagataaaaaccatcgtgttctggcactgtgccaggcatttctagtatagcctcaaaaggtagaaccaaagccttgtgtctttattggacagtgactttggaggaaggaaaaaaaagtctcagcgctgactaaagttgaggcaggcagctgaggttcctaaggggtgctggtttttacccaccatttcaggtttacagagaacaccccccccacacacacaaaaacccagtcagtttcatcaaattgcaggtaatgtgttatgtatagggtgcactcaaatacaaagacagcggttttatttgtagctcacttcctaatgtctgtagctttagtttaggaggcactatcccaattctttagagaaccctttccttggtgaccatggcgggtcacaaaggaaatggtttctaatcgtgccttatttctcgcctccaggataaattgatctggacctttgaaatccaggcatggcaagctggggccacaaatctgtgcttccccccccctcctgccccccccccccacaaaagtcttgagtgctaggtgtgggggtggggtcttaattaaataaaagggaaccacctcaagagtctgctaagaatgcacaaatataatctgctgcccagacttgtaagagattagatattcagggtcagggcaaagctgcttactggaattctcctggtctctcccctcaacagttccatagcccaaatgcagacagtagtgccaaatggggattcacttggtcagaggatatgtatgtgttagaacccaggagcagctctctgcttaaggccatgcagtaagttacatatgtgcttggaaagaatggtagtgagctagtacagtgactgccagatgtcaaagggtaaaggtgtttatcacattcttcttggtaaagtttatgccattgtcacgttgggtggggaggtgtggagtggggaagggaggggtgaagtggggaggggaggggtggagtgggcaggggaggggtcgagtgggaaggggtggggaggggaggggagggatggggggtggggtccaaacctcacagtgcccaggtttcccacccatgtttcattctgatttttggaagtgtacaatgttaccttggctgctttttccacaggatgagagagtggtgggtccaagtagggctcctggctgtgcccttgctggctgcgtacctgcacatcccgccccctcagctctcccctgctctgcactcatggaagacttctggcaagtttttcacctacaaaggcctacgcatcttctaccaaggtgagaactggctatggagaatccaaggacgtgggtcgtgtaggtttcagctgaagttacttattttgtgtcccttggtctgttgctccacagtgaaggtgaggtgaaggtgggggtagaattgtgcctggtagtaattgcagccccatttgtatttgagaaattacttttctcttttgagcgcccctagtgtcaggtaagctatatagtatttcgagatct

SEQ ID NO: 16 - DNA, 2462 bp, Homo sapiens
cggcaaccagcacaccccggcacctcctctgcggcactgcgcctcgcaagcgcagtgccgcagcgcacgccggagtggctgtagctgcccggcgcggcgccgccctgcgcgggctgtgggctgcgggctgcgccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcgacatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtcttttggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacacctttgaaactggaataagtgtttattttctattaataaaaatgaattgtgac

SEQ ID NO: 17 - DNA, 1838 bp, Mus musculus
cccagcaaaaccccagagcctttgtgtaccagtccgggagcagagtaaagcgcagaagtcggagccgagggctgtgtagaactctggcgctatgcggtacctaccatggctgttgctgtgggcattcctacaggtctggggacaatctgaagcccagcaaaagaattacaccttccgctgcctgcagatgtcttcctttgcaaacagaagctggtcccgcacagacagcgtggtctggctgggggatctgcagactcaccgttggagtaatgactcagccaccatcagcttcacgaagccatggtcccagggcaagttgagtaaccagcagtgggagaagttgcagcatatgtttcaagtctatcgagtcagctttaccagggacatacaggaattagtcaaaatgatgtcacctaaagaagactatcccattgagatccagctgtctgcgggctgtgaaatgtaccctgggaatgcttcggaaagctttttacacgtagcatttcaaggaaaatatgtcgtgagattctggggaacgtcctggcagacagtcccaggggccccatcttggttagacttgcccatcaaagtgctcaacgctgatcaagggacaagtgcaaccgtgcagatgctcctgaatgacacctgccccctatttgtccgtggtctcctagaggcagggaagtcagacctagagaagcaagagaagccagtggcctggttgtccagtgtccccagctctgcagatggccataggcagctggtgtgtcatgtctctggcttctacccaaaacctgtgtgggtgatgtgcatgcggggtgaccaggagcaacagggtactcacagaggtgatttcctgccaaatgctgatgagacatggtatcttcaagcaaccctggatgtggaggctggagaggaagctggcctggcctgcagggtgaagcacagcagcctaggaggacaggatatcatcctctactgggatgccaggcaagcacccgtgggcctgatcgtcttcatagtactgatcatgctagtggtggtgggtgctgtagtctactatatctggagaaggagaagcgcttatcaagacatccggtgactcttccttacacctgcctctcctgaaattcagactttccaggctctaggacttcagtcctggtctgctcaggatctggggatgaaggagaggaatcctgaagaagtgaagagcagccagtacgctcttttcaacattaattataagaaattaattatttgagttgtttcgtcagtttccatagtttagaacaaacacaactgcaaatgtgcgtacctgccagaaacaagctgttggcagtgttttatgggatttgcactgaactagaaagcatacttcctgcccaaacagacgctctgaggttagttggcaagtgtaaagtccaacaccaacctggctgtactctgtatttttcaaggtgactagaaaaatggatttgtgtgtgtgtgacatacagctttggggtttgttggcaagtgtaaaatccaacaccaacagtatttttcaagttaactagaaaaatggcttgtgtgtgatgccgtgtgtgtgtgtgtgtgtgtgtgtgtgtgtcacacacacagattttaaaaagtgaatgcaaatatctgcaaatgtttgctaccttagatacaaacctgccaattaatgataactccaagggcctccaatttgtggctcttttaataatgtttgttctaaatgccataatgaccatcttaggacacagtctctatggaaattttgcattaatgactgaaaggtgttttttctttaaaataaaataggatgtaaaatg

SEQ ID NO: 18 - DNA, 1903 bp, Homo sapiens
cagaagcagcaaaccgccggcaagcccagcgaggagggctgccggggtctgggcttgggaattggctggcacccagcggaaagggacgtgagctgagcgcgggggagaagagtgcgcaggtcagagggcggcgcgcagtccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggtgggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaa

SEQ ID NO: 19 - DNA, 727 bp, Mus musculus
cagagacagcggctgcgcacgctccagtccatagcttgcagcagccaggttccatccttgcaaacaccatggacgtcttcaagaaaggcttctccattgccaaggaaggtgttgtgggtgctgtagaaaagaccaagcagggagtaacggaggcagctgagaagaccaaggagggggttatgtatgtgggcaccaaaaccaaggagaacgtggtacaaagtgtcacctcagtggctgagaagaccaaggagcaggccaatgccgtgagtgaagctgtggtcagcagcgtcaacacagtggccaacaagaccgtggaggaggctgaaaacatcgtggtcaccaccggggtggtgcgcaaggaggacttggaaccccctgcacaggaccaagaagccaaagagcaagaggagaatgaagaggccaagagtggagaagactagaaggctgccagccaaccacagaggctcaagggacacccctctgccttggaccctgtctcaacctggcacactgaatgccctgcctagagtgccctgcaggttgcccaagttctctgtccctagcccagtgccacaagtccacacacgctactgccagcgccagcaccccctgctggctccttttaccctatggtcctctgatcaccaatcagatgctgctgtgatttttttttttttaatgattccaaataaaacctgagccccactccccaaaaaaaaaaaaaaaa

SEQ ID NO: 20 - DNA, 488 bp, Homo sapiens
gcacacccaccatggatgtcttcaagaagggcttctccatcgccaaggagggcgtggtggatgcggtggaaaagaccaagcagggggtgacggaagcagctgagaagaccaaggagggggtcatgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagtgctcctctgccttggacaccatcccctcctagcacaaggagtgcccgccttgagtgaca

SEQ ID NO: 21 - DNA, 660 bp, Mus musculus
atgggcatgagcagcctgaaattgctgaaatatgttctgtttatctttaacttgcttttttgggtctgtggctgttgcattttgggctttggcatctatttcctggtccaaaatacctatggagtactcttccgtaaccttcccttcctgacacttggcaacattctggtcattgtgggatccattatcatggtagttgccttcttgggttgcatgggctcaatcaaggaaaataagtgcctgcttatgtcgttctttgttctgctgctgattattctccttgctgaggtgaccatagccatcctgctctttgtgtatgaacaaaaactcaacactttagtggctgagggtctgaatgacagcatccaacattatcactctgacaacagcactatgaaggcatgggacttcatccagacacaactgcagtgttgtggtgtaaatggctcaagtgattggaccagtggtccaccatcttcctgcccatcaggtgcagatgttcagggttgctataataaggcaaaatcgtggtttcactccaatttcttgtatattggaatcattaccatctgtgtatgtgtgatacaggtgctgggaatgtcctttgcactgacactcaactgccagattgacaaaacaagccaggctttagggctgtga

SEQ ID NO: 22 - DNA, 1452 bp, Homo sapiens
ctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagttt

SEQ ID NO: 23 - DNA, 1473 bp, Mus musculus
gaggacggaacaacagtgtttttggccacagacatccgttactgctactggatacttacaacatgcttcagtggagaagacgacactgctgctttgcaaaaatgacctggagccctaagaggtctctgctccggactccccttacgggtgtgctttctctagtgtttctctttgctatgttcttgtttttcaatcatcatgactggttaccaggtagaccaggattcaaagaaaatcctgtgacatacactttccgaggatttcgttctacaaaaagtgagacaaaccatagctcccttcggaccatctggaaagaagtagctcctcagactctgaggcctcacatagcaagcaactccagtaacaccgagctatcaccacagggagtcacagggctgcagaacactctcagtgccaatggcagcatttataatgaaaaaggaactggacatccaaactcttaccatttcaaatatattatcaatgagcctgaaaaatgccaagagaaaagtccatttttaatactattaatagctgcagaacctggacaaatcgaagcaagaagagctatacggcaaacttggggcaatgaaactttggcacctggcatccaaatcatacgggtttttttgttgggcataagtattaagctaaatggctatcttcaacatgcaattcaagaagaaagcagacagtatcatgatataattcagcaggaatatttagatacatactataatctgaccattaaaacactaatgggtatgaactgggttgcaacatactgtccacatactccctatgttatgaaaacggacagtgacatgtttgtcaacacagaatacttaatacacaagttactaaagccagacctgcctcctagacataactattttactggctatctaatgagaggatatgcaccgaacagaaacaaagacagtaagtggtacatgccaccagacctttacccaagtgagcgctaccctgtcttctgctcaggaactggttatgtgttttctggggatctggcagagaagatatttaaggtttctttaggtatccgtcgtttgcacttggaagatgtatatgtagggatctgtcttgccaagttgagagttgatcctgtgccccctcccaatgagttcgtgttcaatcactggcgagtttcttattcaagctgtaaatacagccacctaattacctctcatcagttccagcctagtgaactgataaaatactggaaccatttacaacaaaataagcacaacgcctgtgccaatgcagcaaaggaaaaggcaggcaggtatcgacaccgcaaactacactagaagactatttttgttcaaatgtggagtctgtaaatattgcttaaagcatgtatagttaaaaacttgattatatacataggacaagttttagttcaactcatcacataaaggaattcaaagctattttttaaattttctgaat

SEQ ID NO: 24 - DNA, 3054 bp, Homo sapiens
cggcaaaaagacaacatacttagaaataaagttaaataaggaggtaaaagactcgtacactgaaaactataaaacattggtgaaagaaattaaagaaatgaataagtgaaagatggcccatgttcatggattagaagaactaatattgttaaagtgtccatactacccaaaatgatctacaaattagatgcaatccctatcaaaactccaatggcatatttacagggttagaaaaaacaattataaaattcacatgaacccacaaaagagctcaaatggccaaatcaattgtgagaaaaaaagaacaaagctggaggcatcacagttcttaatttcaaaatatattagaaagctatggcaatgagaacagtatgctactggcataaaaatagacatgtggaccgatggatcagaagagagaccccagtaggaaatttgcacatatacagtgatctgatctgcaacaagggtgccaagaataaacagtgctacaagcagaacgggcaactacagctcttttgtttaacgaaagagagaaaatgaaagaaagggaaaatttcagaagactaggacccatatgaacaaggagggtaactcgaagacaagcagacagatggacactttggatactgtgaaaagcaatcgcaggaggcagactgttgggggatgtgcgcatgttcgatagcatcttttttgctgaagtgatggcgtgccaaaagtattttcagtgggcataatcctcttcacataaatggcctgaccaaggaagaatgactacaagagagacaatgtgactgaattagaaaatgattgccaaagaatagtattaaggagaagaaaacatttttggtcaccaatctctcatataccactactggatatttacaacatgcttcagtggaggagaagacactgctgctttgcaaagatgacctggaatgccaaaaggtctctgttccgcactcatcttattggagtactttctctagtgtttctttttgctatgtttttgtttttcaatcatcatgactggctgccaggcagagctggattcaaagaaaaccctgtgacatacactttccgaggatttcggtcaacaaaaagtgagacaaaccacagctcccttcggaacatttggaaagaaacagtccctcaaaccctgaggcctcaaacagcaactaactctaataacacagacctgtcaccacaaggagttacaggcctggagaatacacttagtgccaatggaagtatttacaatgaaaaaggtactggacatccaaattcttaccatttcaaatatattattaatgagcctgaaaaatgccaagagaaaagtccttttttaatactactaatagctgcagagcctggacaaatagaagctagaagagctattcggcaaacttggggcaatgaaagtctagcacctggtattcaaatcacaagaatatttttgttgggcttaagtattaagctaaatggctaccttcaacgtgcaatactggaagaaagcagacaatatcatgatataattcaacaggaatacttagatacgtactataatttgaccattaaaacactaatgggcatgaactgggttgcaacatactgtccacatattccatatgttatgaaaactgacagtgacatgtttgtcaacactgaatatttaatcaataagttactgaagccagatctgcctcccagacataactatttcactggttacctaatgcgaggatatgcacccaatcgaaacaaagatagcaagtggtacatgccaccagacctctacccaagtgagcgttatcctgtcttctgttctggaactggttatgttttttctggagatctggcagaaaagatttttaaagtttctttaggtatccgccgtttgcacttggaagatgtatatgtagggatctgtcttgccaagttgagaattgatcctgtaccccctcccaatgagtttgtgttcaatcactggcgagtctcttattcgagctgtaaatacagccacctaattacctctcatcagttccagcctagtgaactgataaaatactggaaccatttacaacaaaataagcacaatgcctgtgccaacgcagcaaaagaaaaggcaggcaggtatcgccaccgtaaactacattagaaaagacaattttttttcaaatgtgcaatttgtaaatattgctaaaagcatgtatagttagaactgattacatccgtaggacaagttttagttaaaactcatcacataaagaaattcaagaagtatttttttaatttctgaagaagttaattcttaaaactataacattatataacaaaaaggtttcccaaaacaatctatttaaaaaactgtataaggagattctgtgtattaacatgcaataacaagcatgcataaatcaatggttcaagtcttctgttaggggccaataaaatgtatctgcatatgttttccacataaattttaattcaagaaatgacagtcaaaagatccttcattttagattaagcttttcattttaatatataatttaatgtaaataaaacatcactatcaattttaaggaaaccttttaattgtgcaaaggataaattttttgacctattttagggttctaaatgcaataagatttagttgagttattccacaaacacattataaagttcagatgtttcatcaatgcagttctcacgaaagtatttactttttaaaaataactgagatattattttaaatttcttttattaatactttcttttattaatatatgggggaaaattattttgacatgacgtggtaaaatgtgaaaaactaatgtgtctcaggctcaagtttttatagttattaaatgtttcaaaatagacaagttttgtttcctcattgatgttaagaaccaaactcctatttcaatgagttattggattagaccaattactgcactcttaaacagcaccaccatttaatttcatgtatatctaacttcgaatatatctgtaaagataatcgaagcaaaagtaatcacttaaaggcacccg

SEQ ID NO: 25 - DNA, 606 bp, Mus musculus
atggagtgggtgtgggcgctcgtgctgctggcggctctgggaggcggcagcgccgagcgcgactgcagggtgagcagcttccgagtcaaggagaacttcgacaaggctcgtttctctgggctctggtatgccatcgccaaaaaggaccccgagggtctctttttgcaagacaacatcatcgctgagttttctgtggacgagaagggtcatatgagcgccacagccaagggacgagtccgtcttctgagcaactgggaagtgtgtgcagacatggtgggcactttcacagacactgaagatcctgccaagttcaagatgaagtactggggtgtagcctcctttctccagcgaggaaacgatgaccactggatcatcgacacggactacgacaccttcgctctgcagtactcctgccgcctgcagaatctggatggcacctgtgcagacagctactcctttgtgttttctcgtgaccccaatggcctgagcccagagacacggaggctggtgaggcaacggcaggaggagctgtgcctagagaggcagtacagatggatcgaacacaatggttactgtcaaagcaggccctccagaaacagtttgtag

SEQ ID NO: 26 - DNA, 919 bp, Homo sapiens
cgctcgcctccctcgctccacgcgcgcccggacgcggcggccaggcttgcgcgtggttcccctcccggtgggcggattcctgggcaagatgaagtgggtgtgggcgctcttgctgttggcggcgtgggcagcggccgagcgcgactgccgagtgagcagcttccgagtcaaggagaacttcgacaaggctcgcttctctgggacctggtacgccatggccaagaaggaccccgagggcctctttctgcaggacaacatcgtcgcggagttctcggtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctgcagaaaggaaatgatgaccactggatcgtcgacacagactacgacacgtatgccgtacagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtg

SEQ ID NO: 27 - DNA, 2531 bp, Mus musculus
cgacagcaacggcgcccccggaggatgcggtggagtttgtgctttgctgcatccgtcactgaagaacaaaataagagtaaaggagacaagctgcagagcatgggaggctgtggggtcttctgaaacctttgctgggctttccgcggagcatgagcttttaaaacgaattcttttcaaagaaacccatttgtgtagctggaaaaatgatacacatgctaaatgcagcagcctatcgggtgaaatggaccagatccggtgctgctaaaagggctgcctgcctggtggctgcggcatatgctctgaaaaccctctatcccatcattggcaagcgtttaaagcagcctggccacaggaaggcaaaagcagaagcttactcgcctgcagagaacagagaaatactgcattgcacggagatcatctgtaaaaaacctgcgccgggactaaatgcagcttttttcaaacagctactagaacttcggaaaatcctctttccaaaacttgtgaccactgaaacggggtggctctgcctccactcggtggctctaatctcaagaacatttctctctatttatgtggctggtctggatgggaaaatcgtgaaaagcatcgtggaaaagaagcctcggactttcatcatcaaattaatcaagtggcttatgattgctatccctgctacctttgtcaacagtgctatcaggtacctggaatgcaaactggcattggcctttagaactcgcttagtagaccatgcctatgagacctatttcgcaaatcagacttattataaggtgataaatatggatgggaggctggcaaaccctgaccagtctcttaccgaagacattatgatgttctcgcaatctgtggctcacctgtattccaaccttaccaaacctattttagatgtcattctaacctcctatactctcatccggacagctacatccagaggagcaagccctatagggcccaccctgttagcaggacttgtcgtgtatgccactgctaaagtactgaaagcttgctcgcccaaatttggttcgctggtggctgaagaagcccacaggaaaggctacctgcggtatgtccactcccgaatcatagccaatgtagaagaaattgccttctacagaggacataaggtagaaatgaagcagctgcagaaatgttacaaggctttagcttaccagatgaacctgattttatccaaacgtttatggtacatcatgatagaacaattcttgatgaagtatgtgtggagcagctgtggactaattatggtggctatacccattatcactgcaacgggctttgcagatggtgatctggaggatggtccaaagcaggctatggttagcgatcggacagaggccttcaccactgcccggaacttactggcctctggagctgatgcaattgaaaggattatgtcttcatacaaagagatcactgaactagcaggttatactgctagagtatacaatatgttctgggtcttcgatgaagtgaagagaggcatttataagagaactgtcactcaggaacctgaaaaccatagcaagcgtggaggtaacctggaactacccctcagcgacaccctggccatcaaaggaacagttattgatgtggatcatggaatcatttgtgaaaatgttcccataattacaccagcgggcgaagtggtggcttccaggctaaacttcaaagtggaagaagggatgcatctcttgataactggtcccaacggttgtgggaaaagctctctcttcagaatcttaagcgggctgtggcctgtgtatgaaggagtcctttataaaccgcctccccaacatatgttctatattccacagaggccatacatgtctcttggaagtctccgggatcaagtcatttaccctgactcagcggatgacatgcgtgagaaaggttacactgaccaagacctagaacgcatcctgcacagcgtgcacctctaccacatagttcaaagagaaggaggatgggatgcagtcatggactggaaagatgtcctttccggaggggagaagcagagaatgggcatggcgcggatgttttaccataaaccgaagtatgcattgctggatgaatgtaccagtgccgtgagcatcgacgttgaaggaaagatatttcaggctgctattggggctgggatttccctactctccataacacacaggccttctctgtggaaataccacactcatctattacaattcgatggcgaaggaggctggcgctttgaacagttggacactgctatccgtttaacgttgagtgaggaaaagcaaaagttggagtcgcagctcgctggaattcccaaaatgcaacagagactcaacgaactatgcaaaattctgggggaagactcggtgctgaaaacaatccaaactccagaaaagacatcctaatttatcttgacatgttttcagttaccttctaggtgaagcctcagagactctctctttactgcatgcagtatgttaagctaagtgcagagaaagcaagccggc

SEQ ID NO: 28 - DNA, 3969 bp, Homo sapiens
  misc_feature (3366)..(3366): n=a,c,t or g
gttttgttcgcttggaaatctccctttctgcttgctcttctgtttgcggtatctacttgaaatcttaccgaagtgatgtatattcttgaaacttctgtgggtttctaagtgacacttgagcatgctccagtagctagagccggttttgttcgccagcagatggcctgattcgacctctccaaaaatagacattttaactctctgaactcctgtttaaggaaggatgtaattcgctttgctctctcctcattttcaaggttcaaagggaagctgcgaggattccaaggtcccaccgccctcacagccaatgaggggcctgggagggaggagcttggtgcagcttgagcttctgagagaatcattcccggtagatgcagcggagtctgagctctgctgcatctgtcacagcagaacaaaattaaaaacacaacagtggaagagaaacgctgcagactatgggacgctgtaggactttctaaaacatttgctggggatttctgtgaagcatgatcttttaaaacgaattcttttggaagccggtttgggtaactgggaaaatgacacatatgctaaatgcagcagctgatcgagtgaaatggaccagatcgagtgctgctaagagggctgcctgcctggtggctgcggcatatgctctgaaaaccctctatcccatcattggcaagcgtttaaagcaatctggccacgggaagaaaaaagcagcagcttaccctgctgcagagaacacagaaatactgcattgcaccgagaccatttgtgaaaaaccttcgcctggagtgaatgcagatttcttcaaacagctactagaacttcggaaaattttgtttccaaaacttgtgaccactgaaacagggtggctctgcctgcactcagtggctctaatctcaagaacctttctttctatctatgtggctggtctggatggaaaaatcgtgaaaagcattgtggaaaagaagcctcggactttcatcatcaaattaatcaagtggcttatgattgccatccctgctaccttcgtcaacagtgcaataaggtacctggaatgcaaattggctttggccttcagaactcgcctagtagaccacgcctatgaaacctattttacaaatcagacttattataaagtgatcaatatggatgggaggctggcaaaccctgaccaatctcttacggaggatattatgatgttctcccaatctgtggctcacttgtattccaatctgaccaaacctattttagatgtaatgctgacctcctatacactcattcaaactgctacatccagaggagcaagcccaattgggcccaccctactagcaggacttgtggtgtatgccactgctaaagtgttaaaagcctgttctcccaaatttggcaaactggtggcagaggaagcacatagaaaaggctatttgcggtatgtgcactcgagaattatagccaatgtagaagaaattgccttttacagaggacataaggtagaaatgaaacaacttcagaaaagttacaaagctttagcagatcagatgaacctcattttatccaaacgtttgtggtacatcatgatagaacagttcctgatgaagtatgtttggagcagcagtggactaattatggtggctatacctattatcactgcaactggctttgcagatggtgaggatggccaaaagcaagttatggttagtgaacggacagaagcctttaccactgctcgaaatttactggcctctggagctgatgctattgaaaggattatgtcttcatacaaagaggtcactgaattagcaggctacactgctcgagtgtacaatatgttttgggtctttgatgaagtaaaaagaggcatttataagagaactgctgtcattcaagaatctgaaagccatagcaagaatggagctaaggtagaattacctctcagtgacacattggcaattaaaggaaaagttattgatgtggatcacggaattatttgtgaaaatgttcccataattacaccagcaggagaagtggtggcttccaggctaaacttcaaagtagaagaaggaatgcatcttttgataactggtcccaatggttgtgggaaaagttctctcttcagaattctaagtgggctctggcctgtgtatgaaggagtcctctataaaccacctcctcaacatatgttttatattccacaaaggccatatatgtctcttggaagtcttcgggatcaagtcatttaccctgattcagtggatgatatgcatgataaaggttatacagaccaagatctggaacgtatcctacacaatgtccatctctatcacatagttcaaagagaaggaggatgggatgctgttatggactggaaagatgtcctgtcaggaggggaaaagcaaagaatgggcatggctcgtatgttttatcataaaccaaaatatgccttgctggatgaatgtaccagtgctgtcagcattgatgtcgaaggaaagatatttcaggctgcaaaaggggctggaatttccttactgtctataacacacagaccttctctttggaaataccacacacatttattacagtttgatggtgaaggaggttggcgctttgaacaattggatactgctatccgtttgacattgagtgaagaaaaacaaaagctagaatctcagctagctggaattcccaaaatgcagcagagactcaatgaactatgtaaaattttgggagaagactcagtgctgaaaacaattaaaaatgaagatgagacatcttaatttgttttgacatattttaaaaagttaattattagataaaggctcaaagacattctgttatactgcatgaagtatgttaagctaagcacagagaaaaaaaggcagcaagacatgttttataagattttagcattaaggaagtatatgatctgacttttcagaagaaaataaacaaatgcattatgtaaggtcagtcattatgacttatactaattcctagtgaaggcctaatgcacttgtaaaacaggattttctaggtgaattcctgatgaataccagatttactatgtatatgtggtgtgtctgaagttcttaacaaacatgggcaatattctggaaatgaaacaagttataactgagcaccatttgggttgataccaagtgcataagattcaaactttgagtgacatttagtccatttatggttgatattaggtttaatacctagaattcaaattgattattgctagtggccaactaaacctgtacaaaatagctgacagttttataactaatttcaatataaaaattgttttaatggcatttgttgaaagaaaaaagcatggctaaaatgtatcaaatgccntatttttaaattttggactttaagcatcttaatgagggcatataacaaattaattttagtacaatcttaaatatttttaataaatcctttcattttaaaaagagaattgccaatacagaaaaggagtatccaaacaatgtctcaacctgataatttccttagcagaattacctattgcaacttctgttcagaaatacacagcttgtttttttgcccaaggatgagtctacattttaagaactgcaatggtataaaggaacttaaggattctgagaatcatagtaataacatacattggaatagtactttataatttacaatccccatttacatcatttcaccttaatgttgaggacaatgttttgaaacaaatactatttttcctactttgcttttgagaaaattgacactcagacttgccctaatcatgcactttacttaaggaaagatcgagaaatcaaatgaagttctcctgactctctggtttagtgctcttttgttattatcctttaaatcaaactgggctataatagcaataaaagttagacgaagtgtagaaaataaaataaatttcataatgttaaaaaaaaaaaaaaaaaaaaa

SEQ ID NO: 29 - DNA, 1333 bp, Mus musculus
gaggagtgaggaaaaattctcagaccagctgggcctgtcctccaggaggatgagaaactccaagactgccatttcattctttatccttgtggctgtccttgggtcccaggctggcctcatacaagaaatggaaaaagaagatcgtcgctataaccctccaataattcatcaaggctttcaagacacttcttcagactgctgcttctcttatgccacacagatcccatgtaaaagatttatatattatttccccaccagtggtgggtgcatcaagccgggcatcatctttatcagcaggaggggaacccaggtctgtgccgaccccagcgatcggagagttcagaggtgcctaagcaccctgaagcaaggcccaagatctgggaacaaggtcattgcttgagaaggagggcaggcattgtcacccactttcttctgtcttccccagtgaccgcctgcctaggagaccttgtttttatagatatttaaagcatttatccttctgttcaggtttagagcagtcaacagtattcatgtggactccgcctgacacggttagagccatctggagttgtaaacatcaagattgtctttgagtaattgttgggttttttttcggtttctcagcagattataaatggatacattattagggtagtctttggggctttggaatgtgtctggttctgatacaagcttaagccgggtaatatctagctgagatgaaatcaattttgccctaggccatacatatgtccagctttgtgggttcccagttgttcgccctgccacaatagagcaatgagtgcccccaataaagtccactccatgtagccacaggactgtctctttcttcagattcatagaactacggggccagtctgaaactgggctcttggggtgaaattatctcactcactcaccttgagtacaggagggagatgggaccatataactttgaatattctaaaccaaaagacatcatggtataatttttaaaaattaagaacacggtttattcctctgagcttggtgcaaaacagaggaataccttttccagcagggcgtcttcttctctgcctgacttttatctgcggaacctgaccttcacaccctctacctgaggaagttcaggtagttgttggcaaatctacaagtaagaacctgcacaccaagtatctgggattcctggaatgcctctccatgcaaatgaggcattcccagtactttaaacttcatctagtaatttacatttaccctgaaaactccttcctatactccaaggttcatgtatagccctggtttaccccaataaagtgtatgcacacaagctgtt

SEQ ID NO: 30 - DNA, 2740 bp, Mus musculus
agactggagcccccaggacccttcttcctgagaagcctaactgtcttcagccagatttcctgtctcctcagccccactgagagctggggggggggggtctactaaggttggagtgggggtgactttgaggcccgaggccctcaagggggtcaagcattgctacatcttccctgtgaccctcccctctctccatggggctacgctactccccataacttctcagctttagctccctgaattttggttctttcaaaggatttgggacactcagtttaaccaacactttgaggggctggttgtttgtgctctccgggagaagctctgatccattcctttgtccacccctccttcttcatagacccctttctgtgcacccctaacccagtgggggaggagagtctagtcttgggataggtccatctctttttaggtcagcccgcccccagcttttacaccccaggcataaaaacccgttgtcagtgagaggagttgacagtgtcagagatgaagctactcttggccttggcaggcctcctggcccctctggccatgcttcagacctccaatggtgccaccccagctctcctgggggaagtggagaattcagttgtgctgagctgtatggaagaggccaagcagctagtggacagagcctacaaggagcggagagaaagcatcaagcggacgctccaaagcggctctgccagccccacggagctcctgttttacttcaagcagccggtggcgggcaccagaacagctgtgagggccgctgattatctacatgtggccctagacctgctgaagaggaagctgcagcccctgtggccaaggcctttcaatgttacagatgtgttgacacctgctcagctgaatctgttgtccgtgtcaagtggctgcgcctatcaggacgtgggggtgacatgcccaccgaatgacaagtatcgcaccatcactggacactgcaacaacagacgaagccccactctgggggcctccaaccgtgcctttgtgcgctggttgcccgcagagtatgaagatggtgtctccatgccctttggctggacgccaggagtcaatcgcaatggcttcaaggtgcccctggctcgccaggtctctaacgccatcgtgcgcttccccaacgatcagctgaccaaggaccaggagcgcgcactcatgttcatgcagtggggacagtttctggatcatgacatcaccttgactccagagccagctacccgcttctccttcttcactggcctcaactgcgagaccagctgcctgcagcagccaccctgcttccccctcaagattccacccaatgaccctcgaatcaagaaccaaaaggactgcatccccttcttccgctcctgcccggcatgcaccaggaacaacatcaccattcgcaaccagatcaacgcgctcacttccttcgtggacgccagtggggtgtacggcagcgaggaccccctagccagaaagctgcgcaacctcaccaaccagctggggctgctggctgtcaatacacgattccaagacaatggcagggccctgatgccctttgacagcctgcacgatgacccctgcctcctcaccaaccgctccgcccgcattccttgttttctggcaggggacatgcgctccagcgagatgccggagctcacctccatgcacaccctctttgttcgagagcataaccggctggccacacagctcaagcgcctgaatcctcgatggaatggggagaagctctaccaggaggcccggaagattgtaggggccatggtccagatcatcacataccgggactacctgcccttggtgttggggccagcagccatgaagaagtacctaccgcagtaccgatcctacaacgactcagtagaccctcgaatcgccaatgtcttcaccaatgctttccgttatggccacaccctcatccaacccttcatgttccgcctgaacaatcagtaccggcccacagcggccaacccccgagtcccactcagcaaggtcttttttgccagctggagagttgtgctggaaggtggcattgaccccatcctccgaggcctcatggccactcctgccaaactgaatcgccagaatcaaattgtggtggatgagatccgggagcgactgtttgagcaagtcatgaggataggactggatttgcctgctcttaacatgcagcgcagccgggatcacggcctcccaggatacaatgcctggagacgcttttgtgggcttccacagcctagcacagtgggtgagctcggcacggtgctgaagaacctggagttggcacggaagctgatggcacaatatggcacgcccaacaacattgacatctggatgggcggtgtgtccgagcccctggaacccaatggccgtgtaggccagctccttgcctgcctcattggcactcagtttaggaagctacgtgatggtgatcggttttggtgggagaacccaggcgtgttcagtaaacagcagagacaggccttggccagcatctccttgccccgtctcatctgtgacaacactggcatcaccaccgtgtcgaagaacaacatcttcatgtccaacacatacccccgagactttgtcagctgtaacacccttcctaaactgaacctgacttcctggaaggagacctagaggttgggagtctgccgggagaaggacggagccattggccttcctgtgctatttgtacctgaggttcacactaataaaa

SEQ ID NO: 31 - DNA, 3215 bp, Homo sapiens
gacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 32 - DNA, 1386 bp, Mus musculus
atgagccggcaggtggttcgctccagcaaattccgccacgtgtttggacagccagccaaggctgaccagtgctatgaggatgtgcgcgtctcacaaaccacttgggacagtggcttctgcgctgtcaaccccaagttcatggctctgatctgtgaggccagtgggggaggggccttcctggtgctacccctaggcaagactggacgagtagacaagaacgtgcccctggtctgcggccacactgcccctgtgctagacatcgcctggtgtccacacaatgacaatgtcattgccagtggctctgaggactgcacagttatggtgtgggagatcccggatgggggcctggtgctgcccttgcgggagcctgtcatcaccttggagggccacaccaagagggttggcatcgtggcctggcaccccacagcccagaatgtgcttctcagcgcaggttgtgacaatgtgatcctggtgtgggacgtgggcactggggcagctgtgctgacgctgggcccggatgtgcacccggacacaatctacagcgtggactggagccgggacggtgctctcatctgcacctcctgccgtgacaagcgagttcgtgtcatcgagcctcgcaaaggcactgttgtggctgaaaaggaccgtccccatgaggggactcggccagtgcacgctgtgtttgtgtcagaagggaagattctaaccacgggtttcagtcgcatgagtgagcggcaggtggcgctgtgggacacaaagcacctggaggagccactgtccctgcaggagctggacacaagcagcggagtcctgctacctttttttgatcctgataccaacattgtctacctctgtggcaagggtgacagctctatccggtattttgagatcacttctgaggctccgttcctgcattatctttccatgttcagttccaaggagtctcagcgtggtatgggctacatgcccaaacgtggcctggaagtgaataagtgtgagattgccagattctataagcttcatgagcggaagtgtgagcccattgccatgacagtgcctagaaagtcggacctgttccaggaggacctgtatccgcccactgcaggacccgaccctgccctcacagctgaggaatggctgggtggtcgggatgctggccccctcctcatttccctcaaggatggctacgtgcccccaaagagcagggagctgagggtcaacaggggcctggacagcgctcgcagaagagctacaccagagcccagcggcacgcccagctcggataccgtgtcaaggctggaggaggacgtgaggaatctgaacgccatagtgcaaaagctacaagagcgcctggacaggctggaggagactgttcaggccaagtag

SEQ ID NO: 33 - DNA, 1563 bp, Homo sapiens
gcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaaa

SEQ ID NO: 34 - DNA, 2248 bp, Mus musculus
attttcaaaggggaggagatttttccacaagaaaaggttgttttcatgtttgggatccaggaaagcatccaacggagtggaagcagtatgaaggaagagccgctgggcagcggcatgaacgcggtgcggacgtggatgcagggcgccggggtgctggacgccaacacagcggcgcagagcggggtgggtctggcccgggctcactttgagaagcagccgccttctaacctgcggaaatccaacttcttccacttcgtcctggccctctacgacagacagggccagcccgtggagattgagaggactgcctttgtggggttcgtggagaaggaaaaagaagccaacagcgaaaagaccaataatgggatccactaccggctccagctcctctacagcaatgggatacggacagaacaggatttctatgtgcgcctcatcgactccatgacaaaacaagccatagtgtatgaaggccaagacaagaaccctgaaatgtgccgagtattgctcacacacgagatcatgtgcagccgctgttgtgacaagaaaagctgtggcaaccgaaatgagactccctcagatccagtgataattgacaggttcttcctgaagtttttccttaaatgcaaccaaaattgcctaaagaatgcaggaaacccacgtgacatgcggagattccaggtcgtggtgtctaccacagtcaacgtggatggccatgtcctggcagtctctgataacatgtttgtccacaataactccaagcacgggcggagggctcggaggcttgacccctcggaaggtacgccctcttatctggaacatgctactccctgtatcaaagccatcagcccgagtgaaggatggacgacgggaggcgcgactgtgatcatcataggggacaatttctttgatgggttacaggtcatattcggtaccatgctggtctggagtgagttgataactcctcatgccatccgagttcagacacctcctcggcacatccctggtgtggtggaagtcacactgtcgtacaagtccaagcagttctgcaaagggacaccaggcagattcatctacacagcactcaatgaacccaccatcgactacggcttccagaggttacagaaggtcattcctcggcatcctggtgacccagagcgcttgccaaaggaagtgatccttaaaagagctgcagatctggttgaagccctgtatgggatgccccacaacaaccaggagattatcctgaagagagctgccgacattgcagaggctctgtacagtgtccctcggaaccacaaccagctcccagcccttgctaacacttcggtccatgcagggatgatgggtgtgaactccttcagtggacaactggctgtgaatgtctcggaggcatcacaagccaccaatcaaggtttcacccgcaactcaagcagcgtgtcaccacatggctatgtgccgagcaccaccccacagcaaaccaactataactcagtcaccacaagcatgaatggctacggctcagccgccatgtccaatttgggcggctccccaaccttcctcaatggctcagctgccaactcaccctatgccattgtgccatccagccccaccatggcctcatctacaagcctcccctccaactgcagtagctcctctggcatcttctccttctcaccagccaacatggtctcagcagtgaaacagaagagtgctttcgcaccagttgtcagaccccagacgtcccctcctcccacctgcaccagcaccaacgggaacagcctgcaagcgatatctggcatgattgtccctcccatgtgaaagaattgccttgaagaattttattaatgaagaggttggattctgctacgaaagttatctgacatgagtcccagagtggaacttttaactcaggcctttttaagaggaatcacacaataactgcagatttttaaacaaaatcaccgaccttgcaaatactgaaattggaaagggggtctgccagagcagggtgttggttaaagttgtaacccccgagtatctgggggatatatttattctgtattgataaaaagcaagcccacattttctttttctttctttcttttcttaagcttaactctgcaaccatttgtcttttataaaccattaagctacacacaagggccactataaacaagactccatgttttaatttatgtttttaaagctatggaaggggagaatgaagtggtgatatttacaaaaa

SEQ ID NO: 35 - DNA, 1858 bp, Homo sapiens
acaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgacaggtcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctctt

SEQ ID NO: 36 - DNA, 360 bp, Mus musculus
agtcgatctcccacagcctctgccgcgggtaccatgaagatctctgcagctgccctcaccatcatcctcactgcagccgccctctgcacccccgcacctgcctcaccatatggctcggacaccactccctgctgctttgcctacctctccctcgcgctgcctcgtgcccacgtcaaggagtatttctacaccagcagcaagtgctccaatcttgcagtcgtgtttgtcactcgaaggaaccgccaagtgtgtgccaacccagagaagaagtgggttcaagaatacatcaactatttggagatgagctaggatagagggtttcttgattctgaccctgtatagcttccctgtcatcgcttg

SEQ ID NO: 37 - DNA, 1151 bp, Homo sapiens
acagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcgg

SEQ ID NO: 38 - DNA, 2019 bp, Mus musculus
gccgcgagacatgatcgatgacgccttcgcgcgcgccttcgcggtgtggggcgaggtggcacccctcaccttcacccgcgtgtacggacccgaagcggacattgtcatccagtttggtgtcgcggagcacggagacgggtatcccttcgacggcaaggacggccttctggcacacgcctttccccctggcgccggcgttcagggagatgcccatttcgacgacgacgagttgtggtcgctgggcaaaggcgtcgtgatccccacttactatggaaactcaaatggtgccccatgtcactttcccttcaccttcgagggacgctcctattcggcctgcaccacagacggccgcaacgacggcacgccttggtgtagcacaacagctgactacgataaggacggcaaatttggtttctgccctagtgagagactctacacagagcacggcaacggagaaggcaaaccctgtgtgttcccgttcatctttgagggccgctcctactctgcctgcaccactaaaggccgctcggatggttaccgctggtgcgccaccacagccaactatgaccaggataaactgtatggcttctgccctacccgagtggacgcgaccgtagttgggggcaactcggcaggagagctgtgcgtcttccccttcgtcttcctgggcaagcagtactcttcctgtaccagcgacggccgcagggatgggcgcctctggtgtgcgaccacatcgaacttcgacactgacaagaagtggggtttctgtccagaccaagggtacagcctgttcctggtggcagcgcacgagttcggccatgcactgggcttagatcattccagcgtgccggaagcgctcatgtacccgctgtatagctacctcgagggcttccctctgaataaagacgacatagacggcatccagtatctgtatggtcgtggctctaagcctgacccaaggcctccagccaccaccacaactgaaccacagccgacagcacctcccactatgtgtcccactatacctcccacggcctatcccacagtgggccccacggttggccctacaggcgccccctcacctggccccacaagcagcccgtcacctggccctacaggcgccccctcacctggccctacagcggcccctactgcgggctcttctgaggcctctacagagtctttgagtccggcagacaatccttgcaatgtggatgtttttgatgctattgctgagatccagggcgctctgcatttcttcaaggacggttggtactggaagttcctgaatcatagaggaagcccattacagggccccttccttactgcccgcacgtggccagccctgcctgcaacgctggactccgcctttgaggatccgcagaccaagagggttttcttcttctctggacgtcaaatgtgggtgtacacaggcaagaccgtgctgggccccaggagtctggataagttgggtctaggcccagaggtaacccacgtcagcgggcttctcccgcgtcgtcccgggaaggctctgctgttcagcaaggggcgtgtctggagattcgatttgaagtctcagaaggtggatccccagagcgtcattcgcgtggataaggagttctctggtgtgccctggaactcacacgacatcttccagtaccaagacaaagcctatttctgccatggcaaattcttctggcgtgtgagtttccaaaatgaggtgaacaaggtggaccctgaggtgaaccaggtggacgacgtgggctacgtgacctacgacctcctgcagtgcccttgaactagggctccttctttgcttcaaccgtgcagtgcaagtctctagagaccaccaccaccaccaccacacacaaaccccatccgagggaaaggtgctagctggccaggtacagactggtgatctcttctagagactgggaaggagtggaggcaggcagggctctctctgcccaccgtcctttcttgttggactgtttctaataaacacggatccccaacctt

SEQ ID NO: 39 - DNA, 2334 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttgcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttt

SEQ ID NO: 40 - DNA, 5186 bp, Mus musculus
actcagacttcaagtttttcagttaaatcagtgttttgccctcaacctgtggttctcaacttgggggttgaacaaccctttcacatgagtcatcaaacattgtcagaaagctcacatatatatgattaataacagtagcaaaattatagttatggagtagcaacaaaaatgattttatggttgggcgtcattacaacctaaggcgctgtattaaagggttgcagcattgggaaggttgagcatcattgagcgaaaggactattaaaacatgatagttactttgagatcaactagctaccttggattttgtgcttcgtaagcatacataggttaaacctagaaacaaagtagcctttatctattgttatcagattaaaacaaagcaaaacaaagacatggtatcactttatagggattataattatggaaatctagtttgagaccaaaaaagtgaatgaagccttaaaatattttggtaacgtataaatttgttcctgtcaccatgctggcattagatctgtactgaaaagtctgcatatagctatggtcacagttgggtttattgtatactttaatgaaggtaatttgtagttagctcactagtgtataacatttccatgcttgagatgaaaatacaaaaattaagcaagctgtgttatgtgttaagcctaagtcgatagacttgccagtttatggaaggtccatgaagatgatgaacatgccaaagatgaacacagcagacatattttaaaataatttctcaatgattttcctcttttttttttaatctcaattacagctaccacaacgaagcaaacatgtgctgccatgtttgggaacattactgtgaattacacctatgaatctagtaatcagacttttaaggcagacctcaaagatgtccaaaatgctaagtgtggaaatgaggattgtgaaaacgtgttaaataatctagaagaatgctcacagataaaaaacatcagtgtgtctaatgactcatgtgctccagctacaactatagatttatatgtaccaccagggactgacaagttttcgctacatgactgcacaccaaaagaaaaggctaatacttcaatttgtttggagtggaaaacaaaaaaccttgatttcagaaaatgcaacagtgacaatatttcatatgtactccactgtgagccagaaaataatacaaaatgcattagaagaaatacattcatacctgaaagatgtcagttggacaaccttcgtgcccaaacaaattacacatgtgtagcagaaatcttatatcgcggtgtaaaactcgtcaaaaatgttataaatgtgcagacagatttggggattccagaaacgcctaagcctagttgtggggatccagctgcaagaaaaacgttagtctcttggcctgagcctgtatctaaacctgagtctgcatctaaaccccatggatatgttttatgctataagaacaattcagaaaaatgtaaaagtttgcctaataatgtgaccagttttgaggtggaaagcttgaaaccttataaatactatgaagtgtccctacttgcctatgtcaatgggaagattcaaagaaatgggactgctgagaagtgcaattttcacacaaaagcagatcgtccggacaaggtcaatggaatgaaaacctcccggccgacagacaatagtataaatgttacatgtggtcctccttatgaaactaatggccctaaaaccttttacattttggtagtcagaagtggaggttcttttgttacaaatacaacaaagacaaactgtcagttttatggagataatctctactattcaactgactatgagtttctggtctcttttcacaatggagtgtacgagggagattcagttataagaagtgagtcaacaaattttaatgctaaagcactgattatattcctggtgtttctgattattgtgacatcaatagccttgcttgttgttttgtataaaagctatgatctgcgcaagaaaagatccagcaatttagatgaacaacaggaactcgttgaaagggatgatgaaaagcagctgatggatgtggagccaatccattctgacattttgttggaaacatacaaaaggaagattgctgatgagggcagactgttcctggctgaatttcagagcattccacgggtattcagcaagtttcccatcaaagatgcccgaaagccccacaatcagaataaaaaccgttatgttgacattcttccctatgattataaccgtgtggaactctctgaaataaatggagatgcagggtccacctacataaatgccagctacattgatggcttcaaggaacccaggaaatacattgctgcacaagggccccgggatgagacagttgatgacttctggaggatgatctgggagcaaaaggccacagttattgtcatggtcacacgatgtgaagaaggaaacaggaacaagtgcgcagaatactggccaagcatggaggaaggcactcgggctttcaaagatattgttgtgacaatcaatgaccacaaacgatgtcctgattacatcattcagaagctgaacgttgcacataaaaaagaaaaagcaactggaagagaagtgactcatatccaattcaccagctggccagaccatggggttcctgaagaccctcacctgctcctcaaacttcgacggagagttaatgcttttagcaacttcttcagtggtcccattgtggtgcactgcagtgctggtgttgggcgtacaggtacctacattggaattgatgccatgctggaaggcctggaagcagagggcaaagtggatgtctatggttatgttgtcaagctaaggcgacagaggtgtctgatggtgcaagtggaggcacagtatatcctgattcatcaggctttagtggaatacaatcagtttggagaaacacaagtgaacttgtctgagttacattcatgcctacacaacatgaagaagagagatccacccagtgacccctcccctcgtgaggctgaataccagagacttccttcatacaggagttggaggacacagcacattggaaatcaaggagagaataagaagaagaagaggaattctaatgttgttccatatgactttaacagagtgccacttaagcatgaactggagatgagcaaagagagtgagcctgaatcagatgagtcttcagatgatgacagtgactcagaagaaaccagcaaatacattaatgcatcctttgtgatgagttactggaaaccagaaatgatgattgctgctcaggggccactaaaagaaacgatcggtgacttttggcagatgatattccaaagaaaagtcaaagttattgtgatgttgacagagttagtgaatggagaccaggaagtctgtgctcagtactggggcgaaggaaagcagacttatggagacatggaagtggagatgaaagacacaaacagagcctcagcctacactctccgaacttttgagctgagacattccaagaggaaggagcccagaactgtgtaccagtaccagtgtaccacatggaaaggggaagagctccctgcagaacccaaagacctggtgtctatgattcaggacctcaaacagaagcttcccaaggcttccccagaagggatgaagtatcacaagcatgcatccatcctcgtccactgcagagatggatcccagcagacagggttgttctgtgccttgttcaatctcttggaaagtgcagaaacagaagatgtggttgatgttttccaagtggtaaagtctctacgcaaagcacggcctggggtggtgtgcagctatgagcaataccagttcctctatgacatcatcgccagcatctatcccgcccagaatggacaagtcaagaaaacaaacagccaagacaaaattgaatttcataatgaagtggatggaggcaagcaggatgctaactgtgtccgtccagatggtcctctgaataaagcccaggaagacagcagaggggtgggaaccccggagcctaccaatagtgctgaggaaccagaacatgctgccaatggttctgcgagcccagctccaacccagagttcataggaaaggagtcatgtgggacaacgcagactctcacattagttctttctatttttctagacctaatgaaagaacatggctgtgcagtggtttatggaatctgtgttcacctttgccactgtataaaaatatttaagtttgtcaaaacattttgtacagttttatgcttattttaaaagtgtatctatgtcattcagcaggaatgtatatgtgacagagggtgtctgtgtgtgtgagagtgtgtttatgtatgagtgactgtgtgtgtgcatgtttgtgcgtgtgtatgacatctaaatgtgattggagaatactttcaagccatttcaaatgctttcgagaaacagtgtgccttttctcctcttgaggaaactatacattttatatctaaactgttaatttgtttgagggattaattttttaaaatcccattgaaagtggattcagttgtaagaataacaatgtgtaccattctggaatgacctcaaggtgtcctccttgtcctgttgatgatcttgtagtttaagatgctctttttggatatagataagcgtatgtaagagtgctgtgggtgtgtacagctgatctgggacgtgaacaaaatcaacatgtgagacttatgttccatatactgtcatttcatcactatctcttaatgcatatttaatcaaacatgaaaatctcaagggagactatttttgtatccacatgggaagtagaacattgcaagtcagttgctgtctacacaatagataaaaattactagttaatgctcttggtcatatcgatatatgctatgaacctaaataattgcccttagccaaatataatgtatgttaaaaacacatagaataaaaacaggggcatgaaaacttgtttgtactgaatatttacataggtaacctcgtacagttagttctgttatggaattcaccatttatgggaaatgtaaaattgactatggccatttcctatgcttaagaccatctttgacttgcattactgtgtatttatcttgaatttccccactgttttgtttactcttactgagatataatattgataaccataataaactttcaactattatcttc

SEQ ID NO: 41 - DNA, 4882 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 42 - DNA, 1479 bp, Mus musculus
gccctgctactgaaggacctcacacacacacacacacacacacacacacacacacacacatacacacacgtcacttctgtgttccagtaggtggtggggcgtgaacagggtggagtctcaaggggaagaaaagggccacaggacatcttggcccagctctagtccccagagatgtcgccactactgctgctgctgctgtgcctgctgctggggaatttggagcctgaggaggccaaactgatccgtgtccctcttcaacgaatccaccttggacacagaatcttaaacccactgaatggatgggaacagctggcagagctttctaggacctccacctctggtggcaacccctcctttgtgcctctctccaagttcatgaacacccagtattttggaactattggtttgggaacgcctcctcagaatttcaccgttgtctttgacacgggttcttccaacttgtgggttccgtccacgagatgtcatttcttcagtttggcatgctggtttcaccatcgctttaatcccaaggcctccagctccttcaggcccaatgggaccaagtttgccattcagtatgggaccgggcggctgagcggaatcctgagccaggacaatctgactatcggggggatccacgatgcttttgtgacatttggagaggctctgtgggagcccagcctgatctttgctttagcccactttgatgggatcctgggcctcggcttccccactctggctgtgggcggagttcagcctccgctggatgcgatggtggagcaagggctgctggagaaacccgtcttctccttttacctcaacagggattctgaagggtctgatgggggagagctggtcctagggggctcagaccccgctcactacgtacctcccctcaccttcataccagtcaccatccctgcctactggcaggtccacatggagagtgtgaaggtcggcacagggctgagcctctgtgcccagggctgcagtgccatcctagacacaggcacatccctcatcacaggacctagtgaggagatccgggccttgaataaagccattgggggatatcccttcctgaatgggcagtacttcattcagtgttccaagacgccaacgcttccccctgtctccttccaccttggtggagtctggtttaacctcacaggccaggactatgtcatcaagattcttcagagcgatgttggcctctgcctgttgggcttccaagccttggatatccccaagcctgcgggacccctctggatccttggggacgtctttttggggccctatgtggctgtctttgaccgtggggacaaaaacgtcggcccgcgcgtgggactggcgcgtgctcagtctcgttcaacagaccgggcagaaagaaggactacgcaggcgcagttcttcaaaagacgccctggttagggtacaagctcaccgggccacagcagctatgcttctttccaattaaac

SEQ ID NO: 43 - DNA, 1438 bp, Homo sapiens
gggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttccattgaaaaaaaaaaaaaaaaaaaaaaaaaaaaaaaaaaaaaaaaaaaaaaa

SEQ ID NO: 44 - DNA, 468 bp, Mus musculus
atgggtccgaagctgcttgagtcccgactttgtctcctgctgctgctaggacttgtcctaatgcttgcctcatgcctgggtcaaaccccttcccagaagtttgccatccagcatatcaataataataccaacctccaatgtaatgttgaaatgatgcgtattaacagggctagaagaacatgtaagggcttaaatacttttcttcatacaagttttgctaatgctgttggtgtgtgtggaaatccaagtggcttgtgcagtgacaagagaagtcaaaactgtcataatagttcatctcgggtacatataactgtctgtaacatcaccagtcgggcaacaaattatacccaatgcagataccaatcaagaagatcattggagtactacacagttgcctgtgaccccagaactccacaggacagtcccatgtatccagtggttccagttcacttggatgggacattttag

SEQ ID NO: 45 - DNA, 2003 bp, Mus musculus
cagccgctggagggggcgcctggtgtagatgtgaaaagccgtaaccaggaaccagtaaagatgtggaagtctgtagtggggcatgatgtatcggtttccgtggagacccagggtgatgactgggatacagaccctgactttgtgaatgacatctccgagaaggagcaacggtggggagccaagaccattgagggctctggacgcacagagcacatcaacatccaccagctgaggaacaaagtgtcagaggagcacgacatcctcaagaagaaggagctggaatcggggcctaaggcatcccatggctatggcggtcagtttggagtggagagagaccggatggacaagagtgccgtgggccacgagtatgttgctgatgtggagaaacactcatctcagactgatgcggccagaggctttgggggcaaatatggagttgagagggaccgggcagacaagtcagcggtgggctttgactacaaaggagaagtggaaaagcatgcatctcagaaagattactctcatggctttggtggccgctacggggtagagaaggataaacgggacaaagcagccctgggatacgactacaaaggagagacggagaagcacgagtctcagagagattatgccaagggctttggtggccaatatggaatccagaaagaccgagtggataagagtgctgttggcttcaatgaaatggaggccccaaccacggcgtataagaagacaacacccatagaagctgcttccagtggtgcccgtgggctgaaggcaaaatttgagtccctggctgaggagaagaggaagcgagaggaagaagagaaggcacagcagatggccaggcagcaacaggagcgaaaggctgtggtaaagatgagccgagaagtccagcagccatccatgcctgtggaagagccagcggcaccagcccagttgcccaagaagatctcctcagaggtctggcctccagcagagagtcacctaccgccagagtctcagccagtgagaagcagaagggaataccctgtgccctctctgcccacgaggcagtctccattgcagaatcacttggaggacaacgaggagcccccagctctgccccctaggaccccagaaggcctccaggtggtggaagagccagtgtacgaagcagcacccgagctggagccggagccagagcctgactatgagccagagccagagacagagcctgactatgaggatgttggggagttagatcggcaggatgaggatgcagagggagactatgaggatgtgctggagcccgaggacaccccttctctgtcctaccaagctggaccctcagctggggctggtggtgcggggatctctgctatagccctgtatgattaccaaggagagggaagcgatgagctttcctttgatccagatgacatcatcactgacattgagatggtggatgaaggctggtggcggggccaatgccgtggccactttggacttttccctgcaaactatgtcaagctcctctaatgaccagcccattgtcttccgacttcccgaattcgaagctgctctgcctccctcttcccactccatggtactgctgcaaggacctggctgaacatcatgagatgcctgaagttctggcagtctgtctcccgcctctttaagagctttaggtagaatcgctccaggtgggggtgggggtgggggtgggatccctctgtccctctgtgaccactcttccctgaggtagctcatgaaatcatcttgcagacctgcctccttcagccgcaccccagctctgccaaccttgctctagagtgctgggattcccttgccccgaccctgggtgccagcctagaggggaggctctcacagggctgcctgattcgccctgttgtgcttttgctcatttttcttcccttagcagacaaattggaactgcccttctgtttagtcctaaaactgaaaataaaatgagactgtggctaaaaaaaaaaaaaaaaaaa

SEQ ID NO: 46 - DNA, 1968 bp, Homo sapiens
aattccgccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcatacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgctccaccccctccctattcctgatgcaaatgtctaaccagatgagtttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 47 - DNA, 477 bp, Mus musculus
atgtcctcggccatcgaaaggaagagcctggacccgtctgaggaacccgtggatgaggtgctgcagatacccccatccctgctgacatgtggtggctgccagcagaacataggggaccgctacttcctgaaagccatcgaccagtactggcatgaggattgcctcagctgtgacctctgtgggtgtcggctgggagaggtggggaggcgcctctactacaagctgggacggaaattgtgcaggagagactatctcaggctttttggtcaggatggtctctgtgcatcctgtgacaagcggatccgtgcctatgagatgacgatgcgggtgaaagacaaagtgtatcacctggagtgtttcaaatgcgccgcctgtcagaagcatttctgtgtaggtgacagataccttctcatcaactccgacatagtgtgtgaacaagacatctacgagtggaccaagatcaatgggatcatctag

SEQ ID NO: 48 - DNA, 2304 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggaaaaaggaaatgaaacagagacagagggaagcctgagccaaaatagaccttcccgagagaggaggaagcccggagagagacgcacggtcccctccccgcccctaggccgccgccccctctctgccctcggcggcgagcagggcgccgcgacccggggccggaaaggtgccaggggctccgggcggccgggcgggcgcacaccatccccgcgggcggcgcggagccggcgacagcgcgcgagagggaccgggcggtggcggcggcgggaccgggatggaagggagcgcggtgactgtccttgagcgcggaggggcgagctcgccggcggaggccgagcaagcggaggcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaagggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 49 - DNA, 184 bp, Mus musculus
tgaagctgttcgatagcatctgtaacaacaagtggtttacagacacgtccatcatccttttcctcaacaagaaggacctcttcgaagaaaaaataaaaaagagccccctcacaatatgctacccagaatatgcaggctcaaacacatatgaagaagcggccgcgtatattcagtgtcagtttga

SEQ ID NO: 50 - DNA, 1702 bp, Homo sapiens
ccggcagtcccgagtgcttcccgcagagggctggtggtgggagcggagtggagtcgggcggggccgaagccgggccgtgggcgtagatgggggccgggcggcggcggagcggcggaacgcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggaaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgaatttgtaccccccaacccctgaggaagatgggggcaagaagatcacgctccccgcctgttcccccgccgcttttctcctctttcctctctttgttctcagctccccctgtcccctcagctccaaacgtaggggaggggttcgcacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacgggagcctcctgcccagtcccccaaccccagccgctcggaggccccaaaggaaaaagcacaagaagcgtgagacgccaccattcctggaaaccacagtcc

SEQ ID NO: 51 - DNA, 1015 bp, Mus musculus
ggctattccactgtcagtatttagcaaacatctgtctctaagggatgggccgagctggaggaagattggcagctctaagatccaaaagccaacttcacagggtgattccctgcttctggaggaggggacaggagagcatcaggctggtgcacggagctgagacacgatggaatctggcttcacctccaaggacacttatctaagtcattttaatcctcgggattacttggaaaaatattacagctttgggtccagacactgtgcagaaaatgagatcctcagacatctgctgaaaaatctttttaagatattctgcctgggtgctgtaaagggagaactcctgattgacattggctctggccccaccatctatcagcttctctctgcctgtgagtccttcacggagatcattgtctctgactacacagaccagaacctctgggagctgcagaaatggctgaagaaggaaccaggagcctttgactggtccccagtggtcacctatgtgtgtgatcttgaaggcaacagaatgaagggacctgagaaggaggagaagttgaggcgtgcaatcaagcaggtactaaagtgtgatgtgacccagagccagcctctgggtggggtctctctgcctcctgctgactgcttgctcagcacactgtgcctggatgctgcctgccctgacctcccagcctatcgcactgccctcaggaacctgggcagtctgctcaagccaggaggcttcctggtgatggtagatgccctgaagagtagctactacatgattggggagcagaagttttccagccttcccctgggatgggagactgttcgagatgctgtggaagaggctggttacaccattgagcagtttgaagtgatttctcaaaattactcttctaccacatccaataatgaaggactcttctccctagtggggcgaaagccaggcagatctgaatgacatcctgtgatccctattaaaggcctgctggtgaatttcaggctgtgtctctgg

SEQ ID NO: 52 - DNA, 952 bp, Homo sapiens
tgaactctggatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtca

SEQ ID NO: 53 - DNA, 806 bp, Mus musculus bactrianus
gccgagccccgctctgctgagatgctgcgggcaggagcacctaccgccggctcgttccggacggaagaagtccacaccgggacaaccatcatggcagtggagttcgatgggggtgtcgtggtgggctctgattcccgggtgtcagcaggaacagcagtggtgaaccgcgtgttcgacaagctctcccctctgcaccagcgcatcttctgtgccctctcgggttccgctgctgatgcccaagccatagctgacatggccgcctaccagctggagctacacgggttggagctggaggagccacccctcgttctggctgctgcaaacgtggtgaagaacatctcctacaagtaccgtgaggacttgttagcgcatctcatagtagctggctgggaccaacgtgaggggggacaggtgtatggaaccatgggagggatgctaattcgacagccctttaccatcagcggttctggaagctcctacatttacggttatgtggacgcagcttataagccaggcatgacccctgaggagtgccggcgtttcaccacaaatgccatcactctggccatgaaccgagatggctctagtgggggtgtcatctacctggtcaccatcacagctgctggtgtggaccatcgagtcatcctgggagatgagctgccaaaattctacgatgagtgactgatccccagaagtcccttccttgtttgtaataaactttctggaaccagaaggccggtgcgatgggcaaaggtgaaatatgtgtatcagagagacacggtgtgtggagggaagcgtcctccccg

SEQ ID NO: 54 - DNA, 723 bp, Homo sapiens
ggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctc

SEQ ID NO: 55 - DNA, 2464 bp, Mus musculus
ggaacttcccgggttactacagggtctatgtcacagtgcctgtgagagaggacagagcactctgcagccagcctcagaggcaaagctgaccagcattgaaaagctgcttcttcttcttctctaaaggatttctcttcagagacaaaaagaaaccaccctggacatggcctcagagatccacatgtcggaacccatgtgcctcattgagaacactgaggctcaactagtgatcaaccaggaggctctgaggatcctgtctgccattacacagcctgtggtggtggtggcaatcgtgggcctctaccgcacaggcaaatcctacctgatgaacaagctagctgggaagaggacaggcttttccctgggctccactgtgcagtctcacaccaagggcatctggatgtggtgtgtgcctcaccccaagaaggcagggcaaaccctggttctgcttgacactgagggccttgaagatgttgagaagggtgacaaccagaatgactgctggatctttgctttggcagtcctcctcagcagcaccttcatctacaacagcataggaaccatcaaccagcaggccatggaccagctgcactatgtgacggagctaactgatcttatcaagtcaaagtcatcacctgaccagagtggggtagacgattccgctaactttgtgggcttctttccaacctttgtgtggactctgagagatttctccctcgagctggaggttaacggaaaacccgtcacttctgatgagtacctggaacattccctgaccctgaaaaaaggagctgataagaaaactaaaagctttaatgagccgcgactgtgcatcaggaaattctttccaaagaggaagtgcttcatctttgacaggcctgctcagaggaagcaacttagcaaactggagactctgcgggaggaggagctgtgtggtgaatttgtagaacaagttgcagaattcacctcatacatcttgagctactcttctgtcaagactctgtgtggtggcatcatagtcaatgggccacgtctaaagagcctggtgcagacctatgttggtgccatcagcaatgggtctctcccctgcatggagagtgctgtgctgactttggcccagatagagaactcagcagcagtgcaaaaggccatcacccactatgaagaacagatgaatcagaagattcagatgcccacagaaaccctccaggagctcctggatctgcacaggccaattgagagtgaggccattgaggtcttcctgaagaattctttcaaggatgtagaccaaaagttccagacagaattagggaacctgctggtagccaagcgagatgcctttatcaagaagaacatggatgtctcatcagctcgttgctcagacttgctggaggatatttttggacccctggaagaagaagtaaaattagggacattttctaaaccaggaggttactacctcttccttcaaatgagacaagagctagagaaaaagtataaccaggctcctgggaaggggctccaggcagaagcgatgctgaaaaactactttgattccaaggcagatgttgttgaaacacttctacagacggatcagtcactcacagaggcagcaaaggaggtagaagaggaacgtacgaaggctgaagctgctgaagctgcaaacagagagttagaaaagaagcagaaggagttcgagctgatgatgcagcagaaggaaaagagttaccaggagcatgtgaagaagctgactgagaagatgaaagacgaacagaaacagttattagcagaacaggaaaacatcatagctgctaaacttcgggaacaggaaaaatttcttaaggaaggattcgagaatgagagcaaaaaacttattcgagagattgataccctgaagcaaaacaaatcgtctgggaagtgcactatactctgaaggcccaaggcccaaacctttctgccaagctctctccatcacacactatgttgactgagcatcttcaggctttgaaacaactgctatgaaactcaattcacctcagctcaaaatcaatcatatgcgactccattttggggtcactgtctgaccactgggcactgtcagaggaagtccctctgtgtgcagaatgcatgtatgagcagaggttcagccacctgtgttataggtactctcggccttcatcatgcccagccatacgtttctcctgtataatcttaagtgttcctctttcctacagatagcttctgtaatcacagaacaggcaacttttaactaacttgcaaaatgaattccctttcatttctctgaggactttttctactgttattccaaacctaaatctcatcccaggtttcccttttatctccccactgtgacaacatgtcttgaaattactcaagacaaatgtcttgcaagagcacaagttaataaaaatgattagcccactgtaaaaaaaaaaaaaaaaaa

SEQ ID NO: 56 - DNA, 2168 bp, Homo sapiens
gtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgtttt

SEQ ID NO: 57 - DNA, 971 bp, Mus musculus
tctggaagctacccatcccccaaggggatccatcccttcctgctgcttgccctggtggttggtggcgcagtccaggcctccaagattgtaggtgggcacgaggctcggccccactctcggccttatgtggcatccctgcagctgagcaggttccctgggagccacttctgtggtggcaccctgatccacccgagattcgtgctgacagccgcccactgcctgcaggacatctcctggcagcttgtgacagtggtgctgggtgcccacgacctgctgagctcggagcctgagcagcagaagttcaccatcagtcaggtcttccagaacaattacaaccccgaggagaacctcaatgacgtgcttctcctccagctaaaccggacagcctccctgggcaaggaggtggcggtggcttctctgccccagcaggaccagactctgtcccagggcacccagtgcctggccatgggctggggtcgcctgggcacccaagcacccacgccccgtgtgctgcaggaactgaacgtcacggtggtcaccttcctatgccgggaacacaacgtgtgcacgctggtgccacggagggcagcaggcatatgcttcggagactcgggcggccccttgatctgcaatggcattcttcatggagtggactccttcgtgatccgcgaatgcgcctccctccagttccctgatttcttcgcccgggtgtccatgtatgtggactggattcaaaacgtgctgcggggcgcagagccctgaggtgcccttctgcgctccaggcagcctaaagctggggcgaccagcaggctctagtgggaaaaaaatggagtggggtggactagacctttccaggcttttctttcacccacgcacccacccacgcagcaccccctggagtggagtcagctctgttccctattccatatgacctcaataaaaactgagacatatttaaaaaaaaaaaaaaa

SEQ ID NO: 58 - DNA, 897 bp, Homo sapiens
ggctataagaggagcttgaccgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctctt

SEQ ID NO: 59 - DNA, 203 bp, Mus musculus
ttcaggtgtccaaggcagctgctgacttgatggcctactgtgaggcacatgccaaggaagaccctctgctgaccccagtcccagcctcagaaaacccctttcgggagaagaagttcttctgcgccatcctttaagtctctgagaggaggctgaagagtgttggggctcctgggacatgtagagttcctagcaaagtgggcgcc

SEQ ID NO: 60 - DNA, 3113 bp, Mus musculus
gagctgactgggagatggtggggagcgagctactctggcagaactaaatgtcatggggcacagataaataggaagagcctgcaactcactggcacttggaggctcccgaaggaggctgcctgtcgcccaagcacagagccacaaaggatgcagtctaggagggaagaatcacaagccctgtaagatgagtggagccaaacccccagccaagcaccaatacagaaccccgggacaatgaggacacccccctgcccatagcttccagtgcagccaccaaaagtgccaaaatggaccagcaaatggcactcacatgggggctgtgctacatggcactggtggctctctgttggggacacggggtgacagaggcagaagaaacggtccctctgaagactctgcagtgctacaatgactacaccaaccacatcatctgcagctgggcggacacagaggatgcccaggggctaatcaacatgaccctctatcaccagctagagaaaaaacagccagtgtcctgtgagctcagtgagaaactcatgtggtcagagtgcccgtcatcccaccgctgtgtgcccagaagatgtgtcatcccctatacacgattttccatcacaaacgaagactactactccttccggccagatagtgatctgggcatccagctcatggtgccacttgcccagaatgtgcagccaccacttcccaagaacgtcagcatcagctcctctgaggatcgtttcctgctggagtggagtgtgtcccttggggatgcccaggtctcctggctttcatcaaaggacatagagtttgaggtggcttataagcggcttcaggactcctgggaggatgcctacagtctccacactagcaaatttcaggtgaatttcgagccaaagctattcctacccaacagcatctatgcgccccgtgtgcgcactcggctgtacccgggttcaagcttgtctgggagacccagcagatggagcccagaggctcactgggactcccagccaggggacaaggcccagccacagaaccttcaatgcttctttgatgggatccagtccctccactgctcctgggaggtgtggacccagacgactggctctgtttcctttgggctcttctatcgccccagccctgtagctccggaggagaaatgctctccggtggtgaaggagccgccgggggccagtgtctacacccgctaccattgcagtctacctgtgcctgagcccagtgcacacagccagtacacagtctctgttaagcacctggaacaagggaagttcatcatgagctataaccacatccagatggagcctccaaccctcaacctgaccaagaacagagacagctacagcctgcattgggaaactcagaagatggcttactcattcattgagcacacattccaggtccagtacaagaagaaatcggacagctgggaggacagcaagacagagaacctagatcgagcccatagcatggacctctcccagctggagccagacacctcatactgcgccagggtgagggtcaagcccatctctaactacgatgggatctggagcaagtggagcgaagagtacacttggaagactgactgggtgatgcccacgctgtggatagtcctcatcctggtctttctcatcctcaccttgctcctgatccttcgctttggctgtgtctctgtatacaggacgtacaggaagtggaaggaaaagatccccaaccccagcaagagcctcctgttccaggatggaggtaaaggtctctggcctcctggcagcatggcagccttcgccactaagaaccccgctctccaggggccacagagcaggcttcttgctgagcaacagggggagtcatatgcacatttggaagacaacaacgtgtcacctctcactatagaggaccctaatataattcgagttccaccatccgggcctgatacaaccccagctgcctcatccgaatccacagagcaacttcccaatgttcaagtagagggaccaactcctaacagacctaggaagcaattacccagctttgacttcaatgggccctacctggggcctccccaatcccactctctgcctgatctcccagaccagctgggttccccccaggtgggtgggagcctgaagccagcactgccaggctccttggagtacatgtgtctggcccctggaggtcaagtgcaactggttccattgtcccaggtgatggggcagggccaggctatggatgtgcagtgtgggtccagcctggagacctcagggagcccttctgtggagccaaaggagaaccctccagttgagctgagcatggaggaacaggaggcacgggacaacccagtgactctgcccataagctctgggggccctgagggcagtatgatggcctctgattatgtcactcctggagatccggtgctcactctgcccacagggcccctgtctacctctctgggcccctctctagggttgccctcagcccaaagccccagtctctgtcttaagctgcccagggtcccctctggaagcccagctctagggccaccagggtttgaggactatgtggagctgcctccaagtgtgagccaggctgccaagtcccctccaggccatcctgctcctcctgtggcaagcagccccacagtgatcccaggagagcccagggaggaagtgggcccagcatccccacatcccgaaggcctccttgttcttcagcaggttggggactactgcttcctccctggcctgggacctggctccctctcaccacacagtaagccaccctctccaagtctgtgttctgagactgaggacctagtccaggacttgtctgtcaaaaagtttccctatcagcccatgccccaggcgccagccattcagtttttcaagtccctaaagcatcaggactacctgtccctgcccccttgggacaatagccagtctgggaaggtgtgctgagtctgtctcctcccaatctcaccagcagcctggcaccgcagcctgtggtcctcagcctgagcatcaccacagaagcctctctgagttcacactcctccttgctcccagccctgacatggcaatacccccacctgt

SEQ ID NO: 61 - DNA, 2996 bp, Homo sapiens
gcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctaga

SEQ ID NO: 62 - DNA, 1417 bp, Mus musculus
tgggtgtaagaacgttctctatgtaagttcatgctgctttctttcaccaggagcaatacgagcaataccagttcctctatgacatcatcgccagcatctatcccgcccagaatggacaagtcaagaaaacaaacagccaagacaaaattgaatttcataatgaagtggatggaggcaagcaggatgctaactgtgtccgtccagatggtcctctgaataaagcccaggaagacagcagaggggtgggaaccccggagcctaccaatagtgctgaggaaccagaacatgctgccaatggttctgcgagcccagctccaacccagagttcataggaaaggagtcatgtgggacaacgcagactctcacattagttctttctatttttctagacctaatgaaagaacatggctgtgcagtggtttatggaatctgtgttcacctttgccactgtataaaaatatttaagtttgtcaaaacattttgtacagttttatgcttattttaaaagtgtatctatgtcattcagcaggaatgtatatgtgagagagggtgtctgtgtgtgtgagagtgtgtttatgtatgagtgactgtgtgtgtgcatgtttgtgcgtgtgtatgacatctaaatgtgattggagaatactttcaagccatttcaaatgctttcgagaaacagtgtgccttttctcctcttgaggaaactatacattttatatctaaactgttaatttgtttgagggattaattttttaaaatcccattgaaagtggattcagttgtaagaataacaatgtgtaccattctggaatgacctcaaggtgtcctccttgtcctgttgatgatcttgtagtttaagatgctctttttggatatagataagcgtatgtaagagtgctgtgggtgtgtacagctgatctgggacgtgaacaaaatcaacatgtgagacttatgttccatatactgtcatttcatcactatctcttaatgcatatttaatcaaacatgaaaatctcaagggagactatttttgtatccacatgggaagtagaacattgcaagtcagttgctgtctacacaatagataaaaattactagttaatgctcttggtcatatcgatatatgctatgaacctaaataattgcccttagccaaatataatgtatgttaaaaacacatagaataaaaacaggggcatgaaaacttgtttgtactgaatatttacataggtaacctcgtacagttagttctgttatggaattcaccatttatgggaaatgtaaaattgactatggccatttcctatgcttaagaccatctttgacttgcattactgtgtatttatcttgaatttccccactgttttgtttactcttactgagatataatattgataaccataataaactttcaactatt

SEQ ID NO: 63 - DNA, 4315 bp, Homo sapiens
ggaaattgttcctcgtctgataagacaacagtggagaaaggacgcatgctgtttcttagggacacggctggcttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagaccttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcttggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggctaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgagtgtatatgtatgtgtgtatgggtgtgtgtttgtgtgagagacagagaaagagagagaattc

SEQ ID NO: 64 - DNA, 1314 bp, Mus musculus
atgctgctgctgctggccagatgttttctggtgatccttgcttcctcgctgctggtgtgccccgggctggcctgtgggcccggcagggggtttggaaagaggcggcaccccaaaaagctgacccctttagcctacaagcagtttattcccaacgtagccgagaagaccctaggggccagcggcagatatgaagggaagatcacaagaaactccgaacgatttaaggaactcacccccaattacaaccccgacatcatatttaaggatgaggaaaacacgggagcagaccggctgatgactcagaggtgcaaagacaagttaaatgccttggccatctctgtgatgaaccagtggcctggagtgaagctgcgagtgaccgagggctgggatgaggacggccatcattcagaggagtctctacactatgagggtcgagcagtggacatcaccacgtccgaccgggaccgcagcaagtacggcatgctggctcgcctggctgtggaagcaggtttcgactgggtctactatgaatccaaagctcacatccactgttctgtgaaagcagagaactccgtggcggccaaatccggcggctgtttcccgggatccgccaccgtgcacctggagcagggcggcaccaagctggtgaaggacttacgtcccggagaccgcgtgctggcggctgacgaccagggccggctgctgtacagcgacttcctcaccttcctggaccgcgacgaaggcgccaagaaggtcttctacgtgatcgagacgctggagccgcgcgagcgcctgctgctcaccgccgcgcacctgctcttcgtggcgccgcacaacgactcggggcccacgcccgggccaagcgcgctctttgccagccgcgtgcgccccgggcagcgcgtgtacgtggtggctgaacgcggcggggaccgccggctgctgcccgccgcggtgcacagcgtgacgctgcgagaggaggaggcgggcgcgtacgcgccgctcacggcgcacggcaccattctcatcaaccgggtgctcgcctcgtgctacgctgtcatcgaggagcacagctgggcacaccgggccttcgcgcctttccgcctggcgcacgcgctgctggccgcgctggcacccgcccgcacggacggcgggggcgggggcagcatccctgcagcgcaatctgcaacggaagcgaggggcgcggagccgactgcgggcatccactggtactcgcagctgctctaccacattggcacctggctgttggacagcgagaccatgcatcccttgggaatggcggtcaagtccagctga

SEQ ID NO: 65 - DNA, 1576 bp, Homo sapiens
gcgaggcagccagcgagggagagagcgagcgggcgagccggagcgaggaagggaaagcgcaagagagagcgcacacgcacacacccgccgcgcgcactcgcgcccggacccgcacggggacagctcggaagtcatcagttccatgggcgagatgctgctgctggcgagatgtctgctgctagtcctcgtctcctcgctgctggtatgctcgggactggcgtgcggaccgggcagggggttcgggaagaggaggcaccccaaaaagctgacccctttagcctacaagcagtttatccccaatgtggccgagaagaccctaggcgccagcggaaggtatgaagggaagatctccagaaactccgagcgatttaaggaactcacccccaattacaaccccgacatcatatttaaggatgaagaaaacaccggagcggacaggctgatgactcagaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcagagaactcggtggcggccaaatcgggaggctgcttcccgggctcggccacggtgcacctggagcagggcggcaccaagctggtgaaggacctgagccccggggaccgcgtgctggcggcggacgaccagggccggctgctctacagcgacttcctcactttcctggaccgcgacgacggcgccaagaaggtcttctacgtgatcgagacgcgggagccgcgcgagcgcctgctgctcaccgccgcgcacctgctctttgtggcgccgcacaacgactcggccaccggggagcccgaggcgtcctcgggctcggggccgccttccgggggcgcactggggcctcgggcgctgttcgccagccgcgtgcgcccgggccagcgcgtgtacgtggtggccgagcgtgacggggaccgccggctcctgcccgccgctgtgcacagcgtgaccctaagcgaggaggccgcgggcgcctacgcgccgctcacggcccagggcaccattctcatcaaccgggtgctggcctcgtgctacgcggtcatcgaggagcacagctgggcgcaccgggccttcgcgcccttccgcctggcgcacgcgctcctggctgcactggcgcccgcgcgcacggaccgcggcggggacagcggcggcggggaccgcgggggcggcggcggcagagtagccctaaccgctccaggtgctgccgacgctccgggtgcgggggccaccgcgggcatccactggtactcgcagctgctctaccaaataggcacctggctcctggacagcgaggccctgcacccgctgggcatggcggtcaagtccagctgaagccggggggccgggggaggggcgcgggagggggcc

SEQ ID NO: 66 - DNA, 2572 bp, Mus musculus
ctcccccctctttccttctccctcgctatccgctcccccgcccccgtgcctctggctctgcgcctggctccctcgggtccgctcccctttcccgccggcctggcccggcgtcacgctcccggagtctccccgctcggtggcgtctcattgtgggagggggtcagatcaccccgccgggcggtggcgctggggggcagcggagggggaggggccttagtcgttcgcccgcgccgcccgcccgcctgccgagcgcgctcactgccgctctccctccttgctctgcagccgcggcccatggagcccgccggcccggcccctggccgcctagggccgctgctgctctgcctgctgctctccgcgtcctgtttctgtacaggagccacggggacagaagtgaaggtgactcagcctgagaaatcagtgtctgttgctgctggggattcgaccattctcaactgcactgtgacctccttgttgccggtgggacccattaggtggtacagaggagtagggcaaagccggctgttgatctacagtttcacaggagaacactttcctcgagttagaaatgtttcagatactactaagagaaacaatatggacttttccatccgtatcagtaatgtcaccccagaagatgccggtacctactactgtgtgaagttccagagaggatcatcagagcctgacacagaaatacaatctggagggggaacagaggtctatgtactcgccaaaccttctccaccggaagtatccggcccagcagacaggggcatacctgaccagaaagtgaacttcacctgcaagtctcatggcttctctccccggaatatcaccctgaagtggttcaaagatgggcaagaactccaccccttggagaccaccgtgaaccctagtggaaagaatgtctcctacaacatctccagcacagtcagggtggtactaaactccatggatgttaattctaaggtcatctgcgaggtagcccacatcaccttggatagaagccctcttcgtgggattgctaacctgtctaacttcatccgagtttcacccaccgtgaaggtcacccaacagcccccgacatcaatgaaccaggtgaacctcacctgccgggctgagaggttctaccccgaggatctccagctgatctggctggagaatggaaacgtatcacggaatgacacgcccaagaatctcacaaagaacacggatgggacctataattacacaagcttgttcctggtgaactcatctgctcatagagaggacgtggtgttcacgtgccaggtgaagcacgaccaacagccagcgatcacccgaaaccataccgtgctgggacttgcccactcgagtgatcaagggagcatgcaaaccttccctggtaataatgctacccacaactggaatgtcttcatcggtgtgggcgtggcgtgtgctttgctcgtagtcctgctgatggctgctctctacctcctccggatcaaacagaagaaagccaaggggtcaacatcttccacacggttgcacgagcccgagaagaatgccagggaaataacccagatccaggacacaaatgacatcaacgacatcacatacgcagacctgaatctgcccaaagagaagaagcccgcaccccgggcccctgagcctaacaaccacacagaatatgcaagcattgagacaggcaaagtgcctaggccagaggataccctcacctatgctgacctggacatggtccacctcaaccgggcacagccagcccccaagcctgagccatctttctcagagtatgctagtgtccaggtccagaggaagtgaatggggctgtggtctgtactaggccccatccccacaagtcttcttgtcctacatggagtggccatgatgaggacatccagccagccaatcctgtccccagaaggccaggtggcatgggtcctaggaccaggggtaagggtggcctttgtcttccctccgtggctcttcaacacctcttgggcacccacgtccccttcttccggaggctgggtgttgcagaaccagagggcgaactggagaaagctgcctggaatccaagaagtgttgtgcctcggcccatcactcgtgggtctggatcctggtcttggcaaccccaggttgcgtccttgatgttccagagcttggtcttctgtgtggagaagagctcaccatctctacccaacttgagctttgggaccagactccctttagatcaaaccgccccatctgtggaagaactacaccagaagtcagcaagttttcagccaacagtgctggcctccccacctcccaggctgactagccctggggagaaggaaccctctcctcctagaccagcagagactccctgggcatgttcagtgtggccccacctcccttccagtcccagcttgcttcctccagctagcactaactcagcagcatcgctctgtggacgcctgtaaattattgagaaatgtgaactgtgcagtcttgaagctaaggtgttagaaaatttgatttatgctgtttagttgttgttgggtttcttttctttttaatttctttt

SEQ ID NO: 67 - DNA, 3872 bp, Homo sapiens
cgctcgctcgcagagaagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaacttcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaacgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataaaaaaaaa

SEQ ID NO: 68 - DNA, 1819 bp, Mus musculus
atatattcacaggcagctggctggcatcacgacttgcgtctgaatatttttttttcccactgagatacagtagaagaaccttctgattttcagagatcactctattttaattatggcttcattacattttcctcaatgggcagtgagttttgtcttctttgcccaggctgtgggttcaatggacacttttattgctgctgtgtatgaacatgctgttatactgccaaacaaaactgaaagtcctgtttccactgaagaggctttgctcctgataaacaagaacatagacattttggagagtgcaatcaagctggcagccagacagggtgcacatatcattgtgacgccagaagatggaatctatggttggatcttcaccagggagaccatttacccctacctagaggatataccagaccctgaagtgaactggattccctgtagagaccctaggaggtttggctacacaccagtacaggagagactgagctgccttgccaaggagaactctatctatattatggcaaatattggggacaagaagccatgcaatgctactgatcctcattgtcccccggatggccgttaccaatataataccaatgtggtcttcgattctaagggtaggctaacagcccgctaccataagtacaatctttttgaaccagagattcagtttgatttccccaaagattcagagctggtgacctttgacaccccgtttgggaagtttggcatcttcacttgctttgacattttctcttatgacccagctgtggtggttgtgaaggacacccaggtcgacagtgttctcttacccacggcgtggtacaacaccctgcccctgctttcagcagttccattccattcggtgtgggccagagccatgggggtcaacgtgcttgctgcaaacacccacaacaccagcatgcatatgacagggagtggaatctacagcccggaagctgtccgagtgtaccactatgacatggagacagagagtggccaactgctgctttcagagctgaggtctcggcctcgccagcacgccacccctgcagaggttaactggagcgcttatgccaggactgtgaagccgttctcatcggggcaggcagacttcccaggaaagatttattttgacgaatttagcttcaccaagcttacaggaagtgctggcaattacacagtttgccaaaaggacctgtgctgtcacctgacttacaagatgtctgaaagccgaatggacgaggtgtatgttctgggtgcctttgatggactccatacaggggaaggccagtattacctacagatatgtacattgctgaagtgtcaaaccaccaactcgagaacttgtggggaacccgtggggtcagcttttacaaagtttgaagaattctctctcagtggcacctttcggacaaaatatgttttcccacagatcgtgctaagtgggagtcaacttgccctggaaagatattatgaagtctcaagagatggacgtctgaggagtcgaggtggagcccctttgcctatcttagtgatggccctgtatggaagagtgtttgagagagaccctccgcgcttagggcagggacctgggaagctgcagtgatcccttcattggggaccccacccgcctgccctgacacaaggggcggggtctgcacaggattagcctggcagagagcggggctctaagagcaagaacaaggagctgcagggttccattaggagatacgatgtaagctgctgaaaaggcaaagcaagtgagaggaaacaataaagtaaaaaagcaaaaaaaaaaaaaaaaaaaaaa

SEQ ID NO: 69 - DNA, 1707 bp, Homo sapiens
cgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgctagtgactctcagtgtccccctgatggccgttaccaatacaacactgatgtggtgttcgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgcggtggtggtggatgaagtttcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagcaaaaaaaaaaaaaaaaaaa

SEQ ID NO: 70 - DNA, 1185 bp, Mus musculus
gtacacgctggatgcctctctccgatccaccccactcactcgctcctctctcacctcctctctcacctcctctctctccctcctctctcacctcctctctccctctctcctgcattgattttttttctctcctttttttagttgactgaaacaaaacaaaacaaaagggccactggatgtctgccttcttggggggtgagccagacagactgacaaacaaacagacccagctgagctcgggggagggtttctcctccggttttgcccggcagcagcagcatggacgtgttggctagttatagtatattccaggagctacaacttgtccacgacaccggctacttctcagctttgccatccctggaggagacctggcagcagacatgccttgagttggaacgctacctccagacagaaccccggcggatctcggagacctttggtgaggacttggactgcttcctccacgcttctcctcccccatgcattgaggagagcttccggcgcctagaccccttgctgctcccagtggaagccaccatctgcgagaagagctccgcagtggacattttgctctctcgggacaagttgctatctgagacctgcctcagcctccagccaaccagctcttctctagacagctacacagccgtcaaccaggcccagctcaacgcagtgacctcattaacgccgccctcatcccctgagctcagccgccatctggtcaaaacctcacagactctctcagccgtggatggcacagtgacgttgaaactggtggccaagaaggcttccctcagcccggtgaaggtgggaggggtggcggcggcggcagccgtgacaccagctggagcagttaagagtggacagagcgacagtgagcaaggagggggaggggctgacacatgccctgaaaacaagaagagggtccatcgctgtcagtttaacgggtgccggaaagtttatacaaaaagctcccacttaaaggcccaccagaggactcacacaggtgagaagccttacaagtgctcatgggaaggatgcgagtggcgttttgcacggagcgatgagctcacaaggcactacaggaaacacacaggtgcaaagccctttaagtgtaaccactgcgacaggtgtttctccaggtctgaccacctcgcgctccacatgaagagacatatctaa

SEQ ID NO: 71 - DNA, 1640 bp, Homo sapiens
ggatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctaggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagctctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcac

SEQ ID NO: 72 - DNA, 3633 bp, Mus musculus
agctggcatgggcaacttgaagagtgtgggccaggagcctgggccaccctgtggcctagggctcgggctgggtttagggctgtgcggcaagcagggcccagcctctccagcaccggagcctagccaggcgccagcacccccgtccccaacccgagcagcaccagaccacagccccccgctaacccggcccccagacggacccaggtttcctcgagtaaagaactgggaagtgggcagcatcacctacgacaccctcagtgcccaggctcagcaggatgggccctgtacctcaagacgctgcttgggatccctggtgtttccaaggaagttacagagccggcccacccagggcccttcacccactgagcagctattgggtcaagcccgggacttcatcaatcagtactataactccatcaaaaggagtggctcccaggctcatgagcagcggcttcaggaagtggaggctgaggtggcagccacaggcacctaccagctccgggagagcgagctggtgtttggggccaagcaggcctggcgcaatgctccccgctgtgtgggccggatccagtggggaaagctgcaggtatttgatgctcgggactgcaggactgcacaggaaatgttcacctacatctgtaaccacattaaatacgcaacaaatagaggcaatcttcgttcagccatcacagtgttcccccagcgctgccctggccggggagacttccggatctggaacagccagctgatacgctatgcgggctataggcagcaggatggctccgtgcgaggggaccccgccaacgtggagatcactgagctctgtatccaacatggctggaccccaggaaatggccgctttgatgtgctgcccctgttactccaggctcctgatgagtccccagaactcttcactctgcccccagagatggtcctcgaggtgcctctggagcaccccacgctcgagtggtttgctgcccttggcctgcgctggtatgccctcccagctgtgtccaacatgctgctagaaattgggggcctggagtttcctgctgcccctttcagtggctggtacatgagttcagagattggcatgagggacctgtgtgaccctcaccgctacaacatacttgaggatgtggctgtgtgcatggatctggacaccaggacaacctcatccctgtggaaagacaaggcagcggtggaaattaatgtggccgtgctgcacagttaccagctggccaaagtgaccatagtggaccaccacgccgccacagcctccttcatgaagcacctggaaaatgagcagaaggccagagggggctgccctgccgattgggcctggattgtgccccccatctcaggcagcctaactcctgtcttccatcaagagatggtcaactatttcctgtcccctgccttccgctaccagccagacccctggaagggaagtgcagcaaagggggcaggcatcaccaggaagaagacctttaaggaagtagccaatgcagtgaagatctctgcctcactcatgggcacggtgatggcgaagcgtgtgaaggcaaccattctgtatggctctgagactggccgggcccagagctacgcacagcagctgggaagactcttccggaaggcgtttgatccccgggtcctgtgcatggatgagtatgatgtggtgtccctagagcacgaggcactggtgttggtggtgaccagcacatttggcaatggggatcctccggagaatggagagagctttgcagcagcgctcatggaaatgtcaggcccgtacaacagctcccctaggcctgagcagcacaagagctacaaaatccgattcaacagtgtctcctgctcagacccactggtatcctcttggcggcgcaagaggaaggagtctagcaacacagacagtgcaggagccctgggcaccctcaggttctgtgtgtttgggctgggctcccgagcatacccccacttctgtgcctttgctcgagcggtggacacaaggctggaggagctgggcggggagcgactactgcagctgggccaaggtgatgagctctgtggccaggaggaagctttccgaggctgggcccaggccgccttccaggctgcctgtgaaaccttctgtgtgggagaagatgccaaagctgctgcccgagatatcttcagccccaaacgcagctggaagcgccagaggtaccggctgagtacccaggctgagagcctgcaattactaccagggctgactcacgtgcacaggcggaagatgttccaggctacaatcctctctgtggaaaacctacagagcagcaaatccacccgagccacaatcctggtgcgtctggacaccggaggccaggagggactgcagtaccagccaggggaccacataggtgtgtgcccacccaaccgtcctggcctagtggaggcactgctaagccgagtggaggaccctccgccatccacagaacctgtggccgtggaacaactggagaaaggcagccctggtggccctccccccggctgggtacgggacccccggctacccccatgtacgctgcggcaggctctcacctacttcctggacatcacttccccgcctagtcctcgcctccttcgactgctcagcaccctggcagaagagtccagcgaacagcaggagctagaggctctcagccaggacccccggcgctacgaagaatggaagtggttcagctgccccacactgctagaggtgctggagcaatttccttcagtggcactgcctgccccgctgatcctcacccagctgcccttgctccagccccggtactactctgtcagttcagcacccagcgcccacccaggagagatccacctcaccatagctgtgctggcttacagaacccaggatgggctgggccctctgcactacggtgtctgctccacgtggatgagccagctcaaggcgggagatccagtgccctgcttcatcaggggggctccctccttccggctgccacctgatcctaacttgccctgcatcctggtgggcccagggactggcattgcacccttccggggattctggcaagacagactacacgacattgagatcaaagggctacaacctgcccccatgactttggtgtttggctgccgatgctcccaactggaccatctctaccgggacgaggtactggacgcccagcagcgtggggtgtttggacaagtcctcaccgccttttccagggatcctggcagccccaagacctacgtgcaagacctcctgaggacagagctagccgcggaggttcaccgtgtgctgtgccttgagcaaggacatatgtttgtctgcggcgatgtcactatggcaaccagcgtcctgcaaaccgtgcagagaattctggcaacagagggcggcatggagctggatgaagccggtgacgtcatcggcgtgctgcgggatcagcaacgctaccacgaggacattttcggactcacattgcgcacccaggaggtgacaagccgcatacgcacccagagcttttctttgcaggagcgacagctgaggggcgcagtgccctggtcctttgacccgcctggcccagaaatacctggttcctgacagtcttcctcccctcc

SEQ ID NO: 73 - DNA, 3612 bp, Homo sapiens
atgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctga

SEQ ID NO: 74 - DNA, 3453 bp, Mus musculus
ggagatgccatgtcctgcaccttcacagccctgctccgtcttggactgactctgagcctctggatcccagtgctgacagggtccctccctaagcctatcctcagagtacagccagactctgtggtctccaggtggactaaggtgactttcttttgtgaggagacaattggagccaatgagtaccgcctctataaagatggaaagctatataaaactgtaacaaagaacaaacagaagccagcaaacaaggctgaattctcactctcaaatgtagacctgagaaatgcaggtcaatatcgatgttcctacagcacccagtataaatcatcaggctacagtgaccccctggagctggtggtgacaggagactactggacacccagccttttagcccaagccagccctgtggtaacttcaggagggtatgtcaccctccagtgtgagtcctggcacaacgatcacaagttcattctgactgtagaaggaccacagaagctctcgtggacacaagactcacagtataattactctacaaggaagtaccacgccctgttctctgtgggcccagtgacccccaaccagagatggatatgcagatgttacagttatgacaggaacagaccatatgtgtggtcacctccaagtgaatccgtggagctcctggtctcaggtaatctccaaaaaccaaccatcaaggctgaaccaggtcctgtgatcgcctccaaaagagcaatgaccatctggtgtcaggggaacctggatgcagaagtatattttctgcataatgagggaagccaaaaaacacaaagcacacagaccctacagcagcctgggaacaagggcaagttcttcatcccttctatgacaagacaacatgcagggcaatatcgctgttattgttacggctcagctggttggtcacagcccagtgacaccctggagctggtggtgacaggaatctatgaacactataaacccaggctgtcagtactgcccagccctgtggtgacagcaggaggaaacatgacactccactgtgcctcagactttcactacgataaattcattctcaccaaggaagataagaaattcggcaactcactggacacagagcatatatcttctagtagacagtaccgagccctgtttattataggacccacaaccccaacccatacagggacattcagatgttatggttacttcaagaatgccccacagctgtggtcagtacctagtgatctccaacaaatactcatctcagggctgtccaagaagccctctctgctgactcaccaaggccatatcctggaccctggaatgaccctcaccctgcagtgtttctctgacatcaactatgacagatttgctctgcacaaggtggggggagctgacatcatgcagcactctagccagcagactgacactggcttctctgtggccaacttcacactgggctatgtgagtagctccactggaggccaatacagatgctatggagcacacaacctttcctctgagtggtcagcctccagtgagcccctggacatcctgatcacaggacagctccctctcactccttccctctcagtgaagcctaaccacacagtgcactcaggagagaccgtgagcctgctgtgttggtcaatggactctctggatactttcattctgtccaaggagggatcaacccagcaacccctacaactaaaatcaaagtcccatgatcagcagtcccaggcagaattctccatgagtgctgtgacctcccatctctcaggcacctacaggtcgtatggtgctcaagactcatctttctacctcttgtcatctgccagtgcccctgtggagctcacagtctcagaaaccattgaatcctccacctggtctcccaaaaggcccatcccaccaattcccacagagaacaaggatcacacaatggagaatctcatcaggatggggatggcagtcctggtcctcatcgtcctttcgattctagccactgaggcttggcgaagccatagacagacccaccctgcagctgggaactaatctaaagaaaaaagaatgcatcttcaatgttctacactctgggaaataaagctgatgacccaaagttttctgtcaaaagaaaaaaaaaatcctgttgtggtattgaggaactgttgtaagaatgtctaggaagcaaaagtttggggttcagagggaagtggaagtgtcataatgaggtgcttcctcaataaatgaattactgtccctccacatactgggagcctttgtttcctgaacacacactcttctgagcccataaagtgagggaataggctgtcccacctgcctggaatatctttcacctgtgaattgtattttgctgtattactttatgggatgtattcattcacatttaaaggcctctgtcatctttatgaattgtatttaaggacagttccttgtatgtgtgtgagtgtgcatatacaggagggtcgggtgtatgtattagcctactgccattgtgtgttctttcaggcaacttggtgggcaggggcttgggagacaaaggcttagttgatgttccttgtggcagcagacctcctggaaagcatgcagtccttggggtaggaaatggagtactcagtgtaggttattgctctttcctaagttttcaggggagttggcagttcagggcttggtgaggagacgcttacctggtgtcccttaggacggcagccctctgagtaatcaggttgtggctgctactattttttaaagaaacaaaccaataaaatgactcctgggtcaatgtcttgctcagcatcctccggcaggagatggggaacttatgcagatacccacaactgaacactgcagagaaagatctgaaaatactgaatccagaatgggtaaatacttgcaaaagaacatttagtttttctaacaagtcacactggtacacaaagcacactgaagggcaggtctcatgcccagcggtacgtggccaacactaaatgaactcactggtattttcgaagtctgtgcttataatgcttgtctgttacttatatattatgatgacctgtcatgtgcttttagacgacttcagggaattcataatgtatatgtataaaaaaaaatcacagtactagacggctcacaaatatacagttctatttaccaaggattcctgtataattagcaaaaagattttcattgttttcttcttccatttttccattctgtgtgactacttacattattgtgcctaatgtcatttcactgtgaatttcattttttaagtttttgtgatttaaatgcatttatacatcaaatgtattagtaatgagtactttgagaatcatataatacataaaactttgttcaacttttatattcatatcctttcatatcctaaactatcattaataaatatttaatactaaaaaaaaaaaaaaaaaa

SEQ ID NO: 75 - DNA, 2024 bp, Homo sapiens
tgcgtctctgctgatctgagtccaccctgcagcatggacctgcatcttccctgaaggatctccagggctggagggacgactgccagcaccgagggctcatccatccgcagagcagggcagtgggaggagacgccatgacccccatcgtcacagtcctgatctgtctcgggctgagtctgggccccaggacccacgtgcagacagggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgagtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaat

SEQ ID NO: 76 - DNA, 842 bp, Mus musculus
gatatggcatccatcgtgtcagagatcatgatgtacgtgctcattgtggtgttgaccatatggcttgtggcagagatggtgtactgctacaagaagattgctgctgctacggaggctgctgcacaagagaacgcgtgagtggggctggtagggagggctggggccatttaggtgccatctgtcgttcagagtatctgtgtcagaggcaaatagtgtagttgctcgcagatgaggaaaacggaaacccagagaacaagagggtggcactgctgccaggcagcaaagccgcaactcgaacccaagccttctggttggcagagttacagcttgtcggtcctgggcctccacagattcctgaatgtcccataggtaccctgtagttagaggcctctcattcagactcggggcgggggggggggagcccagtccacagccctctctaatctcgggggcccgggggcctaaggcagggactcaaatctatcccattctattcagggttgggcccggagggtcactgtctgcctttccttcccttgcacagctcagaatacctggccattacatccgagagcaaagaaaactgtacaggcgtccaggtggctgaatagcgctggtaaggttgatggaccgacgggtctgcgcatcgccagccaggagggctcagggacacactcttaagtctccacttcttaccctgcaggctctgggctccgcctcatggaagagccagcccctacgggtaccctcccgccctgcagtggggatcagcccctggtgggtaccctcccccggcagtggggatcagcccttcggtctccccagcctcacagttctgcagt

SEQ ID NO: 77 - DNA, 162 bp, Homo sapiens
gcccctgcagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcgtgagtaggg

SEQ ID NO: 78 - DNA, 2992 bp, Mus musculus
tgccatcataaaggagccatacctgtaaatgccatgcaagttcagctgcctgcaaagaccagaagagggcattggattcaccacatgtgctaagaattgaacttgaatcatctgcaaaaacaaatcaaaggaaatggaagacaataatatgttacctcagttcatccacggcatactatcaacatctcattctctatttacacgaagtatccaagagcttgatgaaggggccaccacaccgtatgactacgatgatggtgagccttgtcataaaaccagtgtgaagcaaattggagcttggatcctgcctccactctactccctggtattcatctttggttttgtgggcaacatgttggtcattataattctgataggctgtaaaaagctgaagagcatgactgatatctatctgctcaacttggccatctctgacctgctcttcctgctcacattaccattctgggctcactatgctgcaaatgagtgggtctttgggaatataatgtgtaaagtattcacagggctctatcacattggttattttggtggaatctttttcattatactcctgacaattgataggtacttggctattgttcatgctgtgtttgctttaaaagccaggacagttacctttggggtgataacaagtgtagtcacttgggtggtggctgtgtttgcctctctaccaggaatcatatttactaaatccaaacaagatgatcaccattacacctgtggcccttattttacacaactgtggaagaatttccaaacaataatgagaaatatcttgagcctgatcctgcctctacttgtcatggtcatctgctactcaggaattctccacaccctgtttcgctgtaggaatgagaagaagaggcacagggctgtgaggctcatctttgccatcatgattgtctactttctcttctggactccatacaatattgttctcttcttgaccaccttccaggaatccttgggaatgagtaactgtgtgattgacaagcacttagaccaggccatgcaggtgacagagactcttggaatgacacactgctgcattaatcctgtcatttatgcctttgttggagagaagttccgaaggtatctctccatatttttcagaaagcacattgctaaacgtctctgcaaacagtgcccagttttctatagggagacagcagatcgagtgagctctacattcactccttccactggggagcaagaggtctcggttgggttgtaaagtaagtgacagtttgcctttttttaagcagggaaggagggagcagtgtgtacatagcaacaagcctcaaagacagtggttcttactttgggtcatgatccctatgtgggggtcaaatgaccctttcacagaggtcactaaaaccattagaaaacataggtatttacattataattcataacagtagcaaaattacagctatgaagtagcagcaaaaataattttattgttgtagatcaccacaacatgaggaactgtattaaagggtcacaggattaggaaggtttcaaaccactgctcatggatatgttgaacaatagagacctttaaatcaggtgcccagaacgttatgattatgccgtgactgaaccatatctcttcttgtatatataatacatgtttgagaaatattttagaataataattggtaaattcttcagctttccagtgaactctgtccctatgaggagcctctttgccttgtggcaatattattttaccaatcttcaccatgtttttccttacttatgacatgaaagacatggaatttaagaaaggagggcatgaggctgtcaggactgagtgagaaggaggagatatgcactgttgctcctgagtgaaaatggaaatgaaagtgagcagggctctcaaatttctttctcatttgggacgaaatgtcttgctctttggttccttctcctatctgtgtttaattttggaggctttatcaggttgtggaaaatctagaaactgtaataggttgttggaaacctcatttgagtaccatagtccttttatacataattgcacaacacatttttgctttgttatttttttttatctatgacaacatggacaatttttttcaatatcacactccactgttgatatgtttctcaagccacagttccttacatgatatttataaaattattgtttataaaatatgcattattagtgattagactaaaaataataagggctcttgtttgatctttccttctgctttccaggggagagcagaaggctaaaagtagtgaatgaccaagaataaggagaaaagccaactccttcatcaggcatagagagctgcagcaaaaaggcagagatctgtgggacagaggaagtggtgtgcttagaactacatagaatcagaagcaaaatggatgccttagcactgaagaaaggtttctgtcaggttataaactggttttatattattgctgctattttctgcctcctcagtacctttgcaactgcctctttcctcatagcatttatctctcaacctcttcctgggaaaggtgtatatggaatagccaaacatgaaaacctggatagttctatgagagaaaaaaaaacactgttatattatgtttttgtgggtaaaacaaaactggatgaagcagggacagaattcttgctttgaaaataatacttgggaacatatcttaattacaggcaaaataaacctggataaaaatgattataaatggagtgggaagaagtatgtcacagattatcttccaacgccttatttttggatataaacataattcaaatatttaaaaattgaaaatagaaaaaaaataaaatcaagcctggaaacttctaaatgtgatgaaatacctttgtaagagctcttatcttgccaaggttgaaaatagttcattagttataaaagaaattctgactttgagcttatgaactaacatagacagctcaggattaacaggg

SEQ ID NO: 79 - DNA, 1979 bp, Homo sapiens
caggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatataaaatttag

SEQ ID NO: 80 - DNA, 15755 bp, Mus musculus
  misc_feature (469)..(472): n=a,c,t or g
  misc_feature (501)..(501): n=a,c,t or g
tcggatctctcttcttatgtgcacaattggactaaaatgcgttgccctgaacaccatacaggtacatttgaagggtgcatatcattatgtctgtgacagttcccaagggctaatgtaggatatacgtaatcatagtctaagtgggtgagcacttgcgatgcacataattttgttgtcagagcactgcagaaagcagggtcaccgccactcttgaacgtgggaaagtgaactcaccacccacgccttcacccctgtgaactctagacacctcctctcgtccatgtatcatgaagtggttgtcagggctcacagtgggcgttagtccatgcacctggaatcaaagcatcagaggttttgtcttcgttttaactcagaggcaatgcattaaaacaacaaagtttttttctttcctgttttattttttaatgttttataaaataatttttcccaaagatagaatttttcttannnncaacacaacacaacacaaacacaactgtngttctcattttaaaagagtgaggtcatcagaaaatacatttatccaaaacaaggtctccgtctcttggaagagagagtactgggaattgaacccagtgccttccacacacaagacaagcattctactgccacggtacaccctaggctgaataatgtctttctgagtatctaatactgactggctctataaaccacttgttcttacttgtgaatgtataattttaaaaggtcaattctcaaaatactgagctgcagtctagcttttcttaccgtctttttatgggaagtatgaatgaaaagtttgscccattcagacctcgatcactgctcagtggctccttagcccaataacattagtaatctcctcagggagtatggagctctgcctttgggacggatgctcaattcactaatttcctgtgacatttttcaagcaacagtccgccatctcactgtgacatgtatcgattttcttaagtgtcagtgtgaaagaggatgggaaatcgcctactggcaaaattgtccccattctttcaagtctgactgtgatttaagaagttcttagtggtcagctagaaggggccacctggccattccttcctctccaccagcaacaatgggagcatgtgattcacaagggaatcacattcaactaaaaagagaaaccggggtatgctgtttgcaaggaacggttgaaactggaactcaatatgtcgtgtggtgtgaaataaacgtgtgtctcacatgttttcccatgctgggggcaggggtaagaaagtaaaaggcagactggttaaagacatggggtggggagggctggagggacgagtggtaagaaatggcgacagaggagatgaaggtaatgtcataatgaaacccatcactgctgtgtgcaactaatagatgctaataaaataggaagttttaatgatttaggtagcttattgcttgcattcacctcactgttaaactatcacttctgggggatccacacaacgagcgagcgagtaaaccagaagatggcgttggaagattagtaatcatatcttttaaacaagataaccatgtgaagtctcaaaaggtttcttgtaatgactgttgtttaaacttctgaaaacagaggatgtagattggctgaggaaaatgttgaaaccgcctaagtcaaggtagaagacacgtgtgtctaagtgaaaaaaagaaaaaagaaaaaaaaaaaaaccaaaaacctcgggttggctgcttctgtccttagtctgtgcacgctttgaagaaatgtaattcctcagcagcaaggctgtgctatctgaagctacaatctctgctttgctccgaggtgtgtctctggtgaccgggatagttcccgacagacagaaggtgttcaaagaatatttttgaatgaatgaaaccccaaaggaagaagaggggaaaatgggtgtgaccaaaattttctttgaacgaaactctgttgtttactaccagggctctgacaatggaaaactaattggggtgaaagaacgacatggcatcctgttaatttctgagaaagcctgttgatgttaggaaaaaaaaacatgccggtgggcatctctgcaccagttttcctgtggccaaaatcagatgtttctcctaaagtccagaacccaggatggaagattaaaagaaaaactgagaaacatgtgaaatgaaaaagttgtcaaaagctttacaaacgctccaagttgacctgtggtggtggtaatctaaaatgatacagaaactggtagtctgcttgcttacctgaaaacaccaagataacatataagctccaggcatccaagctgagctggagaaagtcagcggcaaaagctcatggagtttacatatgaaggtcaaagaaaacacgaaaataaagtaaaaccttcagtcagcctagctgttctatttggggcattggtacctcaccgccaactgcctcccacgaggctgaggttaaaattatcattttaaggtgaattgacatccggaagcgcgctaactacctgagtactcagggatcccccatctcttttatgttgccatgattgaaactttggggactgtgcttgtctgagtcatctcaattcgtcggtttcattcacccaacatgtataagcgtttcaaacacagtatttgggccacggcttataaacttgcctttctatttttctttttagtgagcgtgatattctctaaacgctcagagagacaagactccgctttgcccaaggatgctcccgacctctctcagtctatctcttctgtcacatgctgtgagaaccaagttccctgtgctccagactctccatcacttcccaacctggccatgagcagttagtagttatcagctatgctcagtgcagattccagtatcccctttgcatgcctccaccttcacaggaacgggccataccgacttgtcccatccggttgaggatttctgagtacatcagagtccccagccccctccacaggaggagctgaagaaagccagggtttgtctgaagtgggacagcccttgacccggtgggctctagtccgaagctcctgttcctgcgggacacccaggcacaaggcagaggtggggggcggtcctgggtatggccaacccacgccctctcaaggcggggccgaagcgcccgccctgcactccgcctccggctctataaagttcctctttctcacctcactttcctagtttcaccacttgaacttgggaccctttgctgccctcagctaagagtgcgggtgaggtaaggcctgtagtcgggcagaaggaggagtgtgaggctggtggcagaggaagcctggcttccatctctgagcctgagggagaatgctgagatagcggacccaggctccgctcatctacgctgccctaggacctgtgcacttcgggttttgtatgaagctgtttgggtgggagttccagaacatcccccacgggctgggcgggacgagctaatgggactgtggtgtcatcaaaggatcgcactggccacagcttgtcctcagagggacagcctctgactctctctgctccagtggaaagctcctttccagccctggttcctaaaggacccaaactcatctagggctccagagcgtgattcctaggccgggcagccaagaagagctgagagctccaaacttagggtgctcagagcccctttccccgcatgccccttcttcacttctctggcaagagtgctagtgttgctgtccgcagcaccccttattcccagcctcggcttcattcctgccagggttcgcgctgacattctgcaggttggaatctcctgtttcttggctgcgctgcttgccccataaccagacttccacttgttgcttccaggacccacgtgatggtctctggttgggtaggcctggggttattccgaggacaaagtaagggtgtcatagaagaaagtcaagagagtaagctaggtmccccaaacctgcatggcagggacacaggacctggacaagggctagtccatgtgccaggtccttttcgcctggggcagccagggcaacctaaacccaggaaggggcaagtgtagaaacagtgagggaaaagtgggatgaaagctacttggatccagcacagagggacgagtgaccaaagtgagcgccccagcgtggcgcaagacttgggatctgcagagaagctgtgtagctaggagctttcaacggagcgtgttaatgtaaatgtaaatgaagaaattacctaatttttttaataaaagaaagaacagacaggcaaaaaaaaaaaaaggaggaggaggaggaggaggatggtgcgcgccaagggatgctctctataccttcgtcaaagtaccttctcttgggggacttcggagactctgtcactgcacccgagcaccttgtcagcctcagagactcggggcctcgtgggcactccaagagtttgggacggggcttcctcccgcctccaaagtgatacgaaggtagttgcagggaatgtgtgtctctcctcagcgcacaagcccaggaggaggtccccacgcgtcatgaacttggagacgggcagccggggctcagagttcggcatgagcgcagtgagctgcggcaatgggaaactccgacagtggttgatcgaccagatcgacagcggcaagtaccccgggctggtgtgggagaacgaggagaagagcgtcttccgcatcccgtggaaacacgcgggcaagcaggactacaatcgtgaggaggacgctgccctcttcaaggttagcagcattcagggatccctgggcaggggtgggggtggggatggggaatctgaaagctctgaatgtctgtggctcccgggcaagggactaagaggtgggctcctgcaaggaggaggccagagcatcaagcattggaccctgcttaggcaaagtccccaggagaagggaaagaggttgcaaactctccggggattgcatacacaagaaaccaggtcccaatactgtttgtgtggaggaaagaacttccagcttcaggggcatctctgggggaccgaggttccgtttgcatagcccattcgctgtttcctgccaccaccaccgactgctagggccactctctgcttccctgtctctctgtgttttgttatttttctgagtttctctctctgggttttgtttctttgattgggcacctctactgtctggttctagttctagaagctgcgatctctgattttctttctttgagtagctttgactattccgagtctttctctggtatccccctccgaccccgtgtgagtcccttaggactgatgtccccagagaactggctcactgaactgtgaagcccccagcctccacctgccagcaggccgaggaaggggacttcctgcgggaatttgttcaaagtacctctgtgattttgtagatgtcctctctggggcctgccccctccacagctctgtccccagtcttgcccacacttgattcaggcgctgggcgtgtacagcccatactaggggtctcaggaccccactaacatcatgttccacatttcaggcaacagcaaatttgaaacagtaaccttccttgctgaaatgcaatccatagaattcttttgacgctctgggcttgacttttcttatcatcgttcttaggcttgggcattgtttaaaggcaagttccgagaagggatcgacaagccagatcctcctacttggaagacaagattacgatgtgctctgaacaagagcaatgactttgaggaattggtcgagaggagccagctggatatctctgacccatacaaggtgtacaggattgttccagagggagccaaaaaaggtaaggggttttcccagcccaggtggcaggataaaggcattatggcactcagagagcccttcttcctagagacagtcacgtcctacctctgctgtaggttaagcccagatgtccttttgcccatgtcctctctgttataagtgacaaccctgtggtgttagtataggatgacctggcagactttaagccccatgggtgtgtgggttatgcacttgaaggcattattttcagttactccattcagttaggatctggatcaaatttccaaacaaaatctggaaaatccattaaatgtttacttacctaatatcctctagtaagcattttcaagaggagaaagcacatcccacaccccatacatattcacacttcttgtaataaaactgctagagtttctggtttaacatggcctgctagggtggttatgaatattcagatcttgagttccctctcttccaactagtctacctcaagcagtgctcaggaatctgcatttggttccaaccatacaggatgccttaactaggtaccatctcacaaccagaaaccacttggtggatcacagggatcctgggtggtgtttccttccctggctgtcactcacaagtcagcaaatgtttaatcagtttaatggcaaagacaaatatctctctaagaaattgcttgaaaaacaaacaaacaaacaaaacaaaacaaacctaaaatacccgattggttaatagggctatgcattctaagaattaagtgcataggtacttttataagatttaagtcagttccttgtcttactctgtgttctctcttccttttccccaaacacacaggagcaaagcagctcactttggatgacacacagatggccatgggccacccctaccccatgacagcaccttatggctctctgccagcccaggtatgtggtagactcttggtcttgtggaaggctggcccatgcccttttgactggctccacacagagaggcaaacacaaatgaaaagtgtagggctgacttcttatttgctatggctagtacacacgctgaacaaaaacttggtcagagaaggatgtttcagttccagtgtggtgtcactgtccctgacgccacagttttgttggggagtttgatgtgtcccacctgtggagagaggcttccactgatggtcagatcttctgggaatcagaccttttgtggaagtcaaaggttttggaagtagtactttatcatgtgaaaccgcagagcagctgacttctctaggcgtccctgatgtgaattacagtactgttttattcactttggtggcttaaaaagggcagatttcactgcggtattcttggtgccgtgttcagccatatgatgaagccttacaaaaatcacagctttatacaatgtcctcattgtgctttcagaccctctatggctgttttttacctagtgtgatagacagtccatgtcactttttgggcaaaatgacttggctgctggacaaaaaaaggggttccctgaggagtttgggtgatatgaaaggactccgacacccmctgatgtcttcctcttagcaatccctgttctctgtcagcaggttcataactacatgatgccaccccatgacaggagctggagggattatgcccctgaccagtcacacccagaaatcccatatcaatgtcctgtgacgtttggcccacgaggccaccactggcaaggcccatcttgtgaaaatggtaaggattgtgccagggcagcagacagaagaacaacctgagctcggggtgtggacagcaccacagggcttttccctaccattgagataccagagacacatcatatgaagctgctactgttgttgttgttgttgttgctgctgctgctgctggggtggtggggtggtgggktggtggggtggtggagtggtggtggtggtggtggttgtggggtgttggggtatgttgccttgtcctgtgaaatgttgaagtccttagatccatgataggcctcagtctgtgtggggacttaactagaagaccccagagatcattccaagtagctgaaaagtgccccatttttaatacatagagaaaaacatggatgacaacaaattctcaatgacaagtaatgtcaattataaaactcgtctatattttgttttaacttgagttatcccttatttccgatggtgattaagttggggggtttgttgtatcccacctatctccctagtctgtatctttctactctcctgtaaagtagagagttgtacccagtccacctcagcaggaaatcattgctagttcatgtctcttgaataataatgagtcatctatagctgttcttggtactaaggaaggaaggatcagagcgaaagtaatccacaaagtgtctctacaaatgagtgccctgcccgaaaagacccacaggggtccccccatgctagctgggctctcacagaagaaacgcccactaaccagacacaaaaaaatttcacaaactatgttcagtgagacttgggtcctttagtgtttatttaggtgagtgcaccaagctccacctcgggtccttttttggctgtgtattttaaggtagagtcttgctaaattaccaaggctaggatcttcctgccttcaactcttgagtagctgggactacaatcttgttctarcgggctgaacataaaacaagtttttaggacttrcaagttcactgtttaaatataagtcttgacatgggtcgccgtgcgagtagttcttttatattgttctggcaatactttaccttgtgacaatttcatcaacaccctcactcagtctgtgcatgcttacactaatcttgctttagtgtgacataacttctctgctgccagagaacacggttcagcccctccccctagctaacaaacagtgagcagaataaatgagggttgaataattaattcatctttgaactagtcttatagaagtttgaactctgaccctgctggtaacttgctatgtgggctggtgcaagtccctctccttctgggcctcagtttccctatagatttggagtgagccccaggtttccatccagagctgtactgtggctccttccttcatcaccctaatttttatcactggatgtggactttggactttgtcccataatcacacgttattctgctagcaggtgcttagaggctgtcaggcttgggttggaggccatggcctctcccaactcaagagcctccccgcactcagactcgatacttagacatcatctgatttttatttkcaaatgcaggttgccaggtgacaggaaccttttatgcttgtgccccacctgagtcccaggctcctggaatccccattgagccaagcataaggtctgctgaagccttagcgctctcaggtgagtgtggcgcttcctgtaaagctccgagggagggggcatctctcctctactgaggttgggtgaggatttagactctcgccttgcaggccccggggtctggagtaggcatggtccaggctatgtggacatcacgctgagtcaaatacactattagaaatctccacagcagtaccagctagccaaatactatttggacgatgtctttaaccttctacatcattacctgcccagttttccaggaatgtgtaaccaggctcctcctccagccgacattctccattctcgcagtgtggaaaggctttataggcacaaaagaatgctgtttgtccttttagggtgtagggttggccacaaacaggtggtctgagttgcttccaaggaacactggttctgaaccctggtctctgagaagttcttatsccccctaaaggatcatataggtctgactccctcacaactttgacagaattgctgagcatgtgtggatgtgatctgattttaaagttctgttactaaggaagcctgcacttggagatactgaccagcattttaaaagcccacactccgtggaagcagacatcttatgtccatttagtctttagatgatttttttggatgttttcaaatggaattattagaattctcatcatgccctcggctaccttaaaagcctctgactgaaaacatcaactgcattttgacaattttagacacttcccttgttctcgagggaggaagaagttttaaaatctagttccttccagctctgatgctcagggagactttgtgagccactcaagaacagccgaggagcacatctgggcatcaggggttgtcacagacactagaatgctctagatcctcttctggagcgccaaagacttgtgtgggtgccccaagagtaggaaataaacagctatttatatctctgcaatcttgtgattttggtgacattaaatgaaatgaaacctgccctaccactcacctcagatggccaacgccccctctctttgggtgcaccacttgtgctgttcatagctgcagctatcgaagacaccatgatgtgggctgtcagaacttgccattgaagaatacgaggcttttgtgggtttcttcttctagtttgcataattaattatcaaccctgagtgcacttttcagaaagctattctttccaggcattgttggggctccaaccaccagcacgggtatctatctctgcctggggagccctttgcacacccagcttgccctttcggcccgtgggtggtattttaaagtggcttctgaaatcaacaaaatcatgtgtcaataaattcctgtcttaaagctgtagaaaacctagttgttgggttcttttcagagttgaacacgaagcttagagggatttcagggggttttacattamccactggcttttagagcagctctcatcaatttcttcccctactccaagagagctgacttaaaaataagaaaataaaggtatcattttccagagcccagaaattgttattttagtgcctgtctctaacatatctatgtgggttttgttgttgtgtggttttacttaatgacatcatggtaacaccttagggaagttccagagctgaggacactatttgcttttcttctaagatgtttctgtatttcttttactaatagaaatctgtcccagaggtcaactccaaaatcaaaattgagttgctggaaaacgaattccaattcggtagtattatttcatattgtagacaaaatgccaccactgttaacaccatcatccgaaaagccctcataacaggggtgtgctttctaataaaatttggctgaaaattcaagaaatatatacctctccccaagagaagtaaatggccacaacaacatttgaaaatgatcgtgttagagagatcagtttctttccacaagcttctcttagtattctgtgcttgaggtctaagaatctacagggaataagagcagctaacatctccaagacttccttggtcctaggatctttcacttgttcgtggagcatcttgacactcaagtgttccacctgctgtccttcgtatcagtctagtcaccgagtttttggggctctgagcaaggtggcacctttttcaaatccatcagcactgactccagagttttgttcacagactgccggctgcatatctgcctgtattaccgggacatcctcgtgaaagagctgaccacgacgagccctgaaggctgccggatctcccacggacacacctatgatgttagcaacctggaccaggtcctgtttccctacccggacgacaatggacagaggaagaacattgagaagttgctgagccacctggagaggggactggtcctctggatggctccagatgggctttatgccaaaagactctgccagagtaggatctactgggatgggcccctggcactgtgcagcgatcggcccaacaagctagaaagagaccagacttgcaagctctttgacacacagcagtttctatcaggtaacacacctcacagtctgttagaatggaggtggtggtgggtgctggctataaaggtctcaaatggcagtgtctgcctaccccagacagaggtcttcctcctgagatctgtgagctcatgcagaaatagaattcctgcctgattcatgcctagcctttgtctgttgtgtactcccctgattagcagagggccagaaagaggatccatatttgctgcccaggatagacactggtgtgggttgatctcttaatttatcatcattcttttcactctaggcttttgttttgtttgttttgtcagaatatatgtagctcaggctggcctagaactcctgcctcgggattttatctgtacaccagcacatctggccaatgaattaaaatgtgggctttcagcggcatgtgccccacccccagagaggtttcactgtgttggctctctgctctcagcaagtttatctgctgacacctcagctctttaggggtttctagaagcagttcggttgcagagagcagtggaaatctttgatgtctacccattctggatttgcaccccactagggacagtccccataggcacagttgagaattcatatctgatcagggcagagtcttcatgcctgctctgtggaggcagctttttaatgtcagttctttgatgcagacaagacctgggaacctagctctgggaggaggaataaaggttaatgccagtgagtggatgtggctttctgcttgtgctgggggaggaagccaaggccttgcacatacaaggcaagtgctctgctccaagtggcgatgcccccagccatgggcaggtttcttttcagcaatcttgtctgtttcatgtctctcaggcaggactagcctcagcatgacatccttgtcagaggggcttcattggtccccttctccctgtatcatcctgtccccaaagtgagattgaagcctactctggttctccagttatggagttttagacctagtgccaagtaggacacagctgccaacagctggtgagagaaacagatgctcttggtgcccagacaccacgtggcctccatggttagctagtgaggttaaaaaaataaccctgggccatcagaacattgtgactctttacattaaaatgtctccttggcctgtgctgattgcttgactcagcatggctacttttctttttcttctttgtcttcttctctttgaccttgtgcatttctgtgagtgtagtgctgcagacccaagttcttaaggttgggtcatgttccttaagagtaatgaagtaaaaccagtkccaagtcaggagatcatatgtgaacttgaccatgtgattttgtgtctagggtctgctctaagggctggacttaggggaacagagcccgggctctcccaaagcagacttccacgtgactctggctttccgttcacccgctttaccaggtgtctgaacagtttggtttttttttttctttctttcttgtgggttttcagagctgcaagtgtttgctcaccatggccggccagcaccgagattccaggtgactctgtgctttggtgaggagtttccagaccctcagagacagaggaagctcatcacagctcatgtgagtacctggttacatcacccgtaaatcacacactgtggagctgtcccttttagagaagtggcaagtgacgagtaaatgtcagctcacctgggaaaatagatgtagaccttaaaatagtgcaggaggaagcaggctccagtgaacaccacagctcagggaggcacccgcaacctacttccagacaaattctgtcaccaccgaatcagcagggcagatgacttggacccaaggmtctgtttgttctgtattctttattgtttcatacagacagttacctgcccttttataggaattttcaatagttgggaccaagtactgcccttcgacatctctgtttcttgtgtggttttaaagatgctgtcctttcgagtagagtagcactttctccctgggaggctgcctgttatgtattatgcttcatcgggcctcctaacttcaratagttcccagaccctcgctttgttgctggactttagggagttatttaacagttggacaagggaggtggaggaggctgagtcttcccaggaatcaggtaggtcggtctatcctcacagctagggtttattcggataatgttcatcactcacttaataattaaaaggtaattctgaatacatgatgttttttaattagaaaattttacttaattacatatcttgaaaagtatgcagtgtggagtaaaggttgtgtcccagatagccacaatatctcagtgcaaatgggatattagctctgatgatatctcttagtggagactgaagactaggcatacagcgcaatggaaggcatttgctaggcagtggtaaagccctgggttctaaaccccgcctaggatgggggttgggcactgatgttgaacatccagcctcccttctcggttggaaaaagtaaaatctaagaagcaacaaacgggctggagagatggctcagttgttaagagcacaggctgttcttccagaggtcctgagtttaattcctagaaaccacatgtgccttacaaccatctgcagtgagctctaatgccatcttctggtgtgtttgaagactgctacagtgaactcacatacatataaatcttaaaaaaataaaaggcaatgaaactatgatcctggccttgagccttttctcagttctaactggtggttgatatcaaatgagactgcagatgtgtggatgaatctagcatagataagcagtattttttttttaaggtagtgagtaaattctagcatagatctcattttaaggactttgggtgcagtggggctccgcaaaaagggagcaacaatagtcatataggcaaagggcctcaaaatgctgccccgtggtccacagatggaaaacatacatggtcacccatgaactctgctggtctccttattacagacttaattcatatgggtgcttacagaggaatcctaccagacatcacatatcaaataacaaagaggcttgatttattgatgattggttgttacagagcacacagcctgacttggtgaggctggctttgactggggatgcaatcgatgcttataaacaaactaggtccatcagagccagcgagctgctgtcttgtggctgrccagctctgtcttctacttgtggttcagagttctgtctatttcacagtcatctggttcttcaggatgagcccttctgtcagactcatgagcctcacttacccagcatgttacttagccttttaatttggtcatctcattcaataatgtccagttaactcattcgctaaatatcaaatccaagaggcgattggtttcaaaatgccatatttatcttctattatagaatcaagagttctttttccagggtttttaattccaggtattgtaagagcaaatgaaactggtttttcaaatggctctgaatgtgaactgcttcactgtgttatgttatcctgtgcagcttgtaggtttttacttagagtcctagggtcatttcatgatgtcccaattgtatggtgttgagaagaatattctagtgatgtctttttttcttaaatgtcttattaaaggtggaacctctgctagccagacaactgtattactttgctcaacaaaacactggacatttcctgaggggctacgagttacctgaacacgttaccactccagattaccaccgctccctccgtcattcttccatccaagagtgagaagaaatactctgacagggcagccggttgctgccctttctctttggaagagctaagaagtgagtgggtttccacttgaagacaacaacagggctttgtgaggaaaacagctgtatctgctcaacagaggagcttcccccagaagagtgcctgtcagtcatccaggtcttgacaagtgccaggacttgggtgactgtgccctggcttataactgtgaaacttgatccgaattc

SEQ ID NO: 81 - DNA, 5056 bp, Homo sapiens
cgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtacc

SEQ ID NO: 82 - DNA, 1 bp, Missing
a

SEQ ID NO: 83 - DNA, 501 bp, Homo sapiens
atgactgtgccattgaatggagttattaggcaacataaaacggacaagccagaccaagacttttcagaaggagctcagtttttcctaaagagtaagaaacaaaaaagcctttctgtgggagtctgtttaagacataacggactcgtgcttataaaaggccctttcattctgtttgctgaaaaagtgaagtctactgctgggcatgcctctggggtggtcctctggcagccccaaagccagtgtgggccctacaaagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaa

SEQ ID NO: 84 - DNA, 1602 bp, Rat
tgcacctcctgggcacccgcggtcacacgtgtgaccgaagctggcaagtggacacctctgaggctcggaagaggcatcctggaacagcgatggcaaacttcaagggccatgctctcccagggagcttctttctaatagtggggctgtggtggtcagtgaagtacccactgaagtactttcaccacaagggcttgaagaataacagactgagccgtcagcaggagcgcattgagatcattgaaggtgcagtgaagactctgtttgcaatcattgggatcctggcagagcagtttgttccagatggacctcacctgcacctctaccacgagaaccaatgggtcaagctgatgaattggcagcacagcaccatgtacctattcttcggtgtctcgggactcatggacatgatcacctacctttacttccacatcgtgcccctggggttagacagagtggttttggctatggccgtattcattgaaggttttctcttctacttccacgttcacaaccgccctcccctggaccagcacatccactccctgctgctgttcggtcttttcggagcagctgtcagcatctctctggaggttatccttcgggataacatcgtgctggagctcttccgaaccagtctccttatcttgcagggaacctggttctggcagattggatttgtcctgttcccgccatttggaaggccagaatgggaccagaaggacatggacaacatcatgttcatcaccatgtgcttctgctggcactacttggttgctctctgcatcgtagccatcaactactcccttgtttactgctttctgactcgggtgaagagacgtgcagaaggagaaatcattgggattcagaagctgaagtctgatcacacttaccagtcagcccttttgagtggctcggatgaggagtgacatcaagcatgggggtgtggagacctcacatcctttttaaacaacactggaaaggatgcagcctgtcccctgtacttcaaggcttgccttatgtgctcctgtccctggtactccaaggcttgccttatgtgctcctgtccctggtactccaaggcttgccttatgtgctcctgtccctggtactccaaggcttgccttatgtgctcctagggctctatatgctgcatccctcatctactacaaagctagaggctcaaatacaggaaattagacctcaagtgttttttatgcaccatgttattggaatatttaagcatagtttaacttaaaatctgtattagagtagtaacactgtccacacagaaaagtgaacaccttccagaagcaggcctgtccttatagagcaatgactcgaagactctgaattacactaggaagcgaccatgtggatgaagcaggccggacatcacgtgctgcttctgataacttgcccctcttctctcaatcaagcaggtactttcttctcagaaaagtaccacaagttagatggcgacaaatgtaccacattttctgtatccattcctctgttgagggacatctgggttctttccagcttctggctattataaataagactgctatgaacataaaaaaaaaaaaaaaaaaaaaaaaaaaa

SEQ ID NO: 85 - DNA, 1865 bp, Human
gttgtttttgagatggagttttgcttttgtcacccaggctggagtgcaatggcgcgatctcggctcactgcaacctccctctcccgggttcaagcgattctcctgcctcagtctcccgagtagctgggactacaggctcctgccaccgcgcccggctaatttttttatgtttagtagagacagggtttcaccatgtttgtcaggcttatctcgaactcctgacctcaggtgatctgcctgcctcgccctcccaaagtgctgggattacaggcgtgagccaccgcacctggcctctcatgtttttctataagcagttaagagaagccacacagcatcctgaacactttgctttctatctcttctgccaaatatcctaggtcatcattcttaagttctgccctccatgaagtcctaggaaacgacataattcaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaaaaaaaaaaaaaaaaaaaaaaaaaaaaaaaaaaaaaaaaaaaaaaaaaaaaaaaaaaaaaaaaaaaaa

SEQ ID NO: 86 - DNA, 382 bp, Rat
ttttttttttttgccacgcaattccgaataaagtttattaaataatatgtacagcaaagtagtaactcaacatgtctatcaaatcaatccactgcaataaggaaaaaaattagatgaacagaaaaacctgtgtctgcgtagtacatgcgcttggtgtgcaatttaaatgcaatactttcataggttacatagaccatttttattttttctcaataatatcttttgggggggtagtaacctattccagcaatatgacttaatactactgcagataaatagaacctcgaaaagaaaagtaaatggtattatagtggtcttctcttccccaaagaacaaccgaatatgttaacaatttccaaggactatttttgtgctaaaagtc

SEQ ID NO: 87 - DNA, 285 bp, Rat
aagaactgactattctggctccacttcccacgtgctaggattacaggcaggtgcttccacacctaggtgtgacttcagtaacataccaggtgaggtcatcacaccatagtgcatttccattatggttacattctgctctcaggttgaaagaaaaatgggggattatttttagtgaaagaacaaatttgtggttatctgatctgaaaggaatggaatggagattatttttttctcaggccttggaggaccaggaccggttgctggctggtcagattcatttaagaa

SEQ ID NO: 88 - DNA, 2360 bp, Rat
gagacagcggggaggggaggagagggctgcttctgggaccctaatcgaccaggagaacaagaagccagtcactgctggaggaaaaagagctgacaggggctaacaaggctggaggacagacagggcttcttccctgccaaccaccctagccgcttggaccttggaagagagcacggtaatccttccagacatcgccgcagcaagttagaagacaagctgcctcataaggacatggctttggtgcaaactccaaccccgagccatcagacagaggaggactatgaggctgatgctgagttgctaagggacaaggatgacagtcctctggatgttgaagatgatgttctgtttctaaaacagttcccgagctggagaaagaaggagaagaagcgcattagaacgctctatgctatcgcagaccacattgacgaaagccaccaaaaagctaccaagatcaaagtggtgactacctctgcatcagtcgcctctggagtcctgagtctcctgggtttggccctggctacaacaactgcagggggaagcctggtcctcactgctgttgggcatggtttgggggcagttgccggggtcaccgagatcgtgaccaatgtgaggaaaaactctcgcaataaaagagcccttgctcaggtcaacagcatcatgcctaacagcgaccaggagctggagggggtcaagggagagaagacgacctttgtcacagctgccggtgaccttgtctacaaatgtgggaacgcctgggataatatcaaaaagcacctccgagccctccagctaaccagaacccaaccccacgtcacctcagctgccaaaaagctcatgactgcgggccacgtatcagctcgaagtggcaggcaggtacaaaaggcctttgggggcacagccctggcaatgaccaaaaatgctctgaggatgggacgtgcagctgctgccctctcccttggccaggacatatatactctctgggaggactggaaggatctgaaggcggcaaacccaacagagcttgcagaagagttaagagcacgggctgcagaacgggagcgggtgttagctgaacacacctgtcgctacagaaagctgcagagactcagcaaagaggccgcaaggtcctctttgaaaggaaacaaggtgactcagcctccatcctcctcgactgagagagcaagactctggtgatggtgactgacagatgaataggagccacggagaccttgagtctttgagatcagtgaaggaagaccagggtgggggtggaaggctgatggggcaatgcctgtaactcacatacagggaggtgccagggagttccccagggtctaaaaagggagagagagccctgtcagccccactcttgagcctcccttcttctcccctctgacccagccatcaccagcactctcctgggatcccccatcactcactgtacaagccccctgctaggctttagactgacaccgcttcctgacagcttccatagtaattagcaatgataagctatgagggtccctcccccacctcacctctttcagtgctctcagtctctcaggaaagcgggaactgttgtctcagagccatgcttgcacacaaaggttgtcactggaacctgctaggccagattccaggggaaggagggagagaagcctgggctcaccccttctgcctcaagtcctgagctgattgactgccctgtctcctgtcttaaaaacccttttgtgtgtctccattgctggtttgaaagtcactcgtgggtgctataacacttaaaaagacaaaacagaactaacccccacacagccggggaaggaaagcctagggaagaattgcacaggaggtttgggactgtggcccacccacacaagacttcctgcgttctttcttctcaggctgtccaggtgctggctgtccactgctgtcatcacccagggaccctccgtcctagtgcactgtagaattgagccccttatctctaacccttgataattcctcatttgctggctgatctgaatgtccctccctgctctctgtagctcccagggcttcccaccctcaccacagcacgtggaatctgtgggcacagaagtaccttgggctgagggggaccattgagcgcatgaggtcataagttcctgtctccacctcaggggcaggtaggcagtacccctgcgggctctgcagtatgaaaggggactgggtaggaactcagggtaccctgattggtcaggatgaacccagagggaggagaaagaagaaagggggctgtttgtacttccctctccagaatgttggggttgcgacttttctgaccctcactgtaatgaaataaacactggcagaagctt

SEQ ID NO: 89 - DNA, 1396 bp, Rat
gggacaacaggagcaagaaagagcaggagctgtccagcgctgagaaacacaaaaggtgaccatggctaaggagtggggctacgccagccacaatggtcctgatcactggcatgaactttatccaattgccaaaggggacaaccagtcacccattgaactgcatactaaagacatcaagcatgacccctctctgcagccctggtcagcatcttatgaccctggctctgctaagaccatcctgaacaatgggaagacctgcagagttgtgtttgatgatacttatgacaggtctagtaagtatagcccttcggcagggtcacgtgagtgtgttcagtatctaatggcaagacgcaatttgtgacacggtaacagaattatgggaagcgggagaagtttatccctgaaatggagatgactttagacttggctttagttgtggagaactatattcacacaatgaagaggaatgtcacaccctctcgttgctgcaaaatggccatatgcccaagctaaaagttagcaaaacactccagagacagagtgtggatccccaggggaggacagagagtccacatgggctttctgaccaccgagagacaacgtttttatggttcctggtgatatggagaacagattcaaccatgatgaaagaaataaaatgggtcctctctttcctcgcggatggaaggaggctaattaatgtgaaaaggcagggtcactgtgtgagttaaagaggcctggtttcaggaagtatctttgtggtgagtgtttctgatgtatatgaccactttttcttggatcaatgttagtgtggaattgaagcattcatgggaggttttatttttttaacctacattagtaactgatctgtgaaataaaataagatgaatttgaaatactttgaatatttgaatactaatttcaggtaatttgaaatttcagaaaggcttggtggctcatacctgcaatcccaatactcaagaggcaggggtaagaggactgccataaatatgcagcgacctttgagtttctaatgtgttccaagccagcttgggctatagagtgaaactctgtctccaaaaaaaaaaaaaaaaaaaaaaaaaaaccaagcattactttgttgcaaataaatctaagtgagaattagtctttagtaagtaagaatgcaattttctagaaccacattcttcattaaactaaaaatatcctttgttgattaaacaagaatggccattctggtgatgtcataagaaataatgatagagtgacagacaactcctcccttccaaggtaagaggagagcaaaaacttactacttcctgagctatcgttacatgttaccctttcccagtttttctttgacttaaaagctgaagtatcatttagaacaaaaacc

SEQ ID NO: 90 - DNA, 1743 bp, Rat
ggcacgagggagaaagcaggagccgtccagcacggaggaaggcgaccatggccaaggagtggggctacgccagtcacaacggtcctgaccactggcatgaacttttcccaaatgccaagggggaaaaccagtcgcccattgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggagcttcatttggttcactggaacccgaagtataacacttttaaagaagccctgaagcagcgcgatgggatcgctgtgattggcatttttctgaagataggacatgagaatggcgagttccagattttccttgatgcattggacaagattaagacaaagggcaaggaggcgcccttcacaaagtttgacccatcctgcctgttcccggcatgccgggactactggacctaccagggctcattcaccacgccgccctgcgaggaatgcattgtgtggctgctgctgaaggagcccatgaccgtgagctctgaccagatggccaagctgcggagcctcctctccagtgctgagaacgagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctcttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaagtagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaaaaaaaaaaaaaaaaaaaaaaaaaaaaa

SEQ ID NO: 91 - DNA, 1738 bp, Rat
acgtaccggggtccggaggacttgtgtacagcggcaatgggcggtgtcggggagcccggagggggacccgggccgcgggaggggcccgcaccgctgggggcgcccctacccatcttccgctgggagcagatccgccagcatgacctaccaggcgacaagtggctggtcatcgagcgccgtgtctacgacatcagccgctgggcacagcggcacccagggggtagccgcctcatcggccaccacggtgcggaggacgccacggatgccttccacgccttccaccaagatctccattttgtgcgcaagttcctgaaacccctgttgattggagagctagccccagaggaacccagccaggatggagctcagaatgcccagctgatcgaggacttccgagccttgcgccaggcagctgaagacatgaagctgtttgaagctgatagcactttctttgcactcctgctgggccacatcctggctatggagttgttggcctggcttatcatctacctcttgggccctggctgggtgtccagtatccttgctgccctgatcctggccatctctcaggcccagtgctggtgtctgcaacatgatctaggtcatgcttccatcttcactaagtccaggtggaaccatgtggcccagcagttcgtgatggggcagttgaaaggcttttccgcccactggtggaatttccgccacttccagcaccatgccaaacccaacatcttccacaaagacccagatgtgactgtcgcacctgtcttcctcctgggggagtcatctgtggagtatggcaagaagaaacgcagatacctgccctacaaccaccagcatctatacttcttcctgattggccctccgctgctcaccttggtgaactttgaagttgaaaatctggcgtacatgctggtgtgcatgcagtggacggacttgctgtgggctgccagtttctactcccgctttttcttgtcctactctcccttctatggtgccactgggacactgctcctctttgttgctgtcagggtgctggagagccactggttcgtgtggatcacgcagatgaaccacatccccaaggagattggccatgaaaagcatcgggactgggcaagctctcagctggcagccacctgcaatgtggaaccttcgctcttcattgactggttcagcgggcacctcaatttccagattgagcaccacctcttccccacgatgccaaggcacaactaccggagggtggcccccctggtcaaggcgttctgcgccaagcacggcctacactacgaggtgaagcctttcctcaccgctctggtggatatcatcgggtccctgaagaagtctggcgacatctggctggatgcatacctccatcaatgaaggcagcacccttatgggtggtgaaggggtaagggtccagactccagcagtcaccgagtcactgggcaagattgacagtcatcctcaccccctgctggggcagcctgtctgcccgcctggtcctgctggctttcctcagtcctcagcattttctggtcagcaatcctatggccatggcacatgtccaacaggaccagggtggagggaacatacttaaaatgacacggtgagcatagcatgttttcctagagcaagaactggaaggaaaacttgttatttttatataaaaagcaacccagacacccatccacgggtatccacatgactgactgcagcttggactgtgtttcat

SEQ ID NO: 92 - DNA, 1 bp, Place Holder
a

SEQ ID NO: 93 - DNA, 393 bp, Rat
tttttttttatgacacgttttcttttatttaaaatagagctctttatgctttacagaaacaagtgcaacgagtgcttaattcattgtctttgccactttccaaaacaatatgctttctgaaaatgcatacataaaaatataacatttaggcagagaagaatgtacacctggaggcggcaagaagttatgcaattgtattaaaaagctttaaaataaatacttttttatgactagctgttggcaaagttaaacattttggtatgaaggctatcactgagttcttactaaattctaaaatatgattatttcttaacaatataagtatacatgactataaaatgcatatgttcgcagatccaaaagtcatgaaacatctgaatgtcatccacgact

SEQ ID NO: 94 - DNA, 1611 bp, Rat
atgcggtcctttctgctgttcactttctcggcgtgcgtgctgctggcccgggtgctgctggctggcggcgcgagcagcggcgccggggacacccggccaggcagcaggcgccgggcgagagaggcgctggcggctcaaaagatcgaggtgcttgttctattgccccgggacattacgtacttgttctcgctggcccgggtgaggccggccatcgagtacgcgctgcgtagcgtggagggcaatggcaccgggaggaagctgctgccgccaggcactcgcttccaggtggcctacgaagactcggactgcggcaaccgcgcgctcttcagtcttgtggaccgcgtggcggcggcgcgcggcgccaagccggatctcatcctggggcccgtgtgcgggtacgcggcggcgccggtggctcggctggcgtctcactgggacctgccgatgctgtccgcaggagcgctggccgccggtttccagcacaaggacacggaatactcgcacctcacgcgcgtggcgcctgcctacgccaagatgggagagatgatgctcgctctgtttcgccaccaccactggagccgtgcagccctggtctacagcgacgacaaactcgagaggaactgttatttcaccctcgagggggtccacgaggtttttcaggaggaggggttgcacacgtctgcctacaatttcgacgagaccaaagacttggacctggacgacatagtgcgctacatccaaggcagcgagcgagtggtgatcatgtgtgccagtggtgacaccattcggagaatcatgttggcggtgcacagacacggcatgaccagtggagactacgctttcttcaacattgaactcttcaacagttcttcctacggagatggctcgtggaggagaggagacaaacacgactctgaagctaaacaagcatactcgtccctccaaacagtcaccctactgaggaccgtgaaacctgagtttgagaagttttccatggaggtgaaaagttctgttgagaaacaagggctcaatgaggaggattacgtgaacatgtttgttgaagggttccatgacgccatcctcctctacgttctggctttacatgaagtactcagagctggctacagcaagaaggatggggggaaaatcatccagcagacttggaacaggacatttgaaggtatcgccgggcaggtgtccatagatgccaacggggaccggtatggggacttctctgtggttgctatgactgacactgaagcaggcacccaagaggtcattggtgattactttgggaaagaaggccggttccaaatgcgatcgaatgtcaaatatccttggggccctttgaaactgagactagatgagaccagaatcgtggagcataccaacagctctccttgcaaatcatcaggtggcctagaagaatctgcagtgacaggaatcgttgtcggggccctactaggtgctggcttgctaatggccttctactttttcaggaagaaatacagaataaccattgagaggcgaaatcagcaagaggaaagcaacatcgggaagcatcgagagctgcgagaagattccatcagatcacatttttcggtggcttaa

SEQ ID NO: 95 - DNA, 2081 bp, Rat
gcatggtcgactacacgcccaaataagaagccacctctaagcaaaatagctatatgtataaacggagggcgaatatatacaagtatatatatatgtatattacagacgcacaggtttacacccggtgaactttttctttttctttttctttttcctttttttttaagaaaaactagtgacattggagagaaggacgcttcctctctatcttttggcgcattagtgaagggggtattctattttgttaaagcgcccaaggggaccgggaaccttggagagaagagtggggaggaaagaggaagggtgggtggggggcagagggcgagtcggcggcggcgagggcaagctcttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgcctccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaacagaaggggcgttcttgaa

SEQ ID NO: 96 - DNA, 445 bp, Rat
  misc_feature (290)..(290): n=a,c,t or g
  misc_feature (411)..(411): n=a,c,t or g
tattttgtaaatgaaatgtattatgttaaaagctgtcagcagctgtcaaaaataagcttttgttgtgaaagaaaaatgtgtgttagataaaaacaaaacaaaacaaaaaaagtcaaaaatatcctgttttcatatatagcacctatttgaatatactctttctttaatatttcttttagcatcaccatttcagtgctgtggagggatctccgtgtcacgtgttgtcatggtaatggcttgctaagaaatcagtgataaccgtacaaagtgggcggtgctgaggggcttgnggatccttgctgcaaagctttgcagaatgtaagaggctctgtttacccttggccctccctcccacctccctacaaccattgcctgctctgagttgtcctatgacagcaagatgcaccctgngtcactcttggaacgttttgacaattgtgtgtca

SEQ ID NO: 97 - DNA, 2366 bp, Rat
ccacgcgtccggagcaacagagcacagtagcccaagggggtgcctgcggccaacagccacccgtgtgcctaggacctctgggctggaatgaagctggaggtctaggaaagcaattccacccctttgctctcctcagccctgcagggtggtttaccagcccctgccagttagctatggatggatgaaaggagatttctctaaccttccattctgtgaccaccttctcttctaccatggaaaaagcctcattgcctctgactataacatctcacccaaggccctttaaccaacaactcccagagcccccagccccgagatgtgtcttggaaccccaggacagcctcgacttggcccctgcccttgtgtgtgccctttgctgctgcttcggaatcatctactgctgctttggctaccgctgcttcaaggcagtgatgtttctctcgggtctgctgtcaggagccctggtgatcttcctcctgtgccataaagagcgggtgctagagacacagctgagcctggaggtgagcgcaggcatagcactgggcatcggactcctctgcggcctggtcaccatgctggtccgcagtgtcgggctctttctgaccggtctcctgctaggtctgaccctgggtgttggaaccttattgggtactgaacccatctaccagccgcattcagcctgggtgccggtcggcggactgatggggctggcactgctgggagccctgctcacacttcggtggccacgtccattcacagtcctgggcacagcactgctaggtgctgcggtgctggtggcctgtgctgactacttcctggaaggactggcactgggcactagactgggtgaacgcctgcaggcacttccagagttgcttcctctctgctggtatagctgggtcttgctgggaacctggccagtcttgggggctcttgggacactggcccagtggaaactcatggctgaggaacgtgggagccgcaccaatgtgatcttgagccaccagcaaaggcatctccagctccttcggatccatcagcagcaagaggctaagaggcatcggaactcttctgggacaggactgtgtggaggcagctatcggaaccagcttacccccaatatccggagccctgctcacagtccagctccaagttatctccagagtcttcgagagtatgagctggtaccaggcacccaggccccaggcacccacactatcctggacctggattctgattgcagctccactggcctgcttaccacacctcactctgaccagacctgagcctaacctccagtgacactgatacccctggtgggggcaggagattgctaagtggatagggcctgagcccataggacccatacagatttccctacctcttagacttgggaataggttctgtgcccagaccaacccttttagagacaggcagagaaaattcttataaagatgggggggagggggtggaagacaaagtacaagcacctacctctgtccagtagtagaggtgccctggtccctagagacactgactctgaaacaaggaggtatgcccaaaatagttttttattaatttctgtaatgctgaggtggaacccagagcattgcccatattagacaagtgttctgaactacaacccattcccaaaaacctgttttgtttgggttttgttttttggtttgtttttggttttgtttggttagattggggttttggtctctcaagacagggcttctttgtgtagccctggctgtcctgcaactcactttgtagcccaggctggccttgaactcacagggatctgcttgcctgtgcctccccagtaccgggactaaaggcatgcaccaccatacccagtgatagttttttggcaggaggaatggcacagaagttccccggctccttactcgggggtgattgggcttctggttggcctttcttcctggaccctacactcgtgaatcctgctacctctgcggggggctccatcttccatgctgctttccccctctcctcagtggaggaggaccacagcatctgcctcagctcccctctctccaaaagctggctccttgacctttttctcagaggagcctggtctttggggctgcactgtagccaagtgccttctgtcttttaaagtagctttcctcctaaaccagaattcgggcccagctactgaccattctaactctccctcctctgattctcctgaccaagatctatttcctggtttcccagacatagtaaagaaaatatatctttcccctgagcagcagatctgtaataagagggaggaagaacaaggaatttgggaataaaatggcattgaaaattcaaaaaaaaaaaaaaaaaaaaaa

SEQ ID NO: 98 - DNA, 2240 bp, Human
acacagagcctgggctgcgacttgaaagagtttaggcagcaacagagtgaccctgggggtgctcctgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttcctaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactg

SEQ ID NO: 99 - DNA, 1613 bp, Rat
cagaaatccaccaggtccgtgctggtctgtgccccacagctgtctgcagagcatggttgcttcttccttcatggacgcaagaggctgctaggactatgttccagtaaatgaggtctgcagctcgagtctctcgctctaattcccacccgcggacacgccatccaaccagagagaatgaggggaccacgtggggctcacagccttccaggactgagagggatggtgacaggaagtgtcctccctctatcctgagacccagacggcaagaatgtggatgccacgggggtgaaccacagaaaacttcaaggcatgtgcggttccgagagcccctggaggtggctgtccactacattgcccgcaaggacacgacagccgccatcaaggtccccagccggccagcttcccatggtggctctccactccagccagcatcctgcagcggctccctattcctgtggctgacactatgtgctctgcttggagtggtactggtcctgtactgtggccaggccaaacgtgtcacagcagccctggaggacctcttggctcagctcctcgccctaatcttacgcctgtggcgtgtggtccttgcttgttggcactgacccctgcagctctgacttgaggctcaatggtgatgtcacctcaggagagcactggaggttgatgctgttgggagcctggagtggtttgaaggattgtgcatgctgggggagctcaggcactaaggctaaccccaggacagagttctgctagccaatgcttgacaaacccaggaactctaagaggttgctatagacctttaaatgggaaaggagggaggttctggctcgatgctacaggcacctcctactccagtcagcacgggctgggatcttgggattttaagactgaatcagagaaagaactcgaccattatagccgggaattcctatgtccctgtccagtcctctgtcttgggagccatagcctggatgtcaccgtacatagctctttgagggtgcgtttgggaaggcgagccccaatctcctgctgctttgagggctgggcccagcttttgccacaccatcacgagacagggtgcctctctcgctccagtccatggagcccgtgagaattgtccttttctctgagcccacttcatgcgcagtgatccatcaggggtcactgtcgtgtgggaacagagtccagctctgaacacagttgctctcagaacaggagtgtggcaccgagggtcttcttccggggccacacacaggcccaaagccatcgggcctgcccaccagctgcaggccctgtgagtgtcctgaacatctgtgtactgttctgtcactcgtgttgaaaggcaaggggaagcgagcaccagcgtgtagcaaccgcttcagagcatcccagacccgcctggagggggagccctgagctcagcggggaggcccagtcggacaccaggaggatccgcaagggggaccctgtaccaccctggaacaaacaaatgagcagggtttgggggccagaatgagactgggggtagtcctaaggtacccctctacttaggtgggcagacaaagaccccatattaaaatacctgcagcctcttcaaaaaaaaaaaaaaa

SEQ ID NO: 100 - DNA, 325 bp, Human
  misc_feature (26)..(26): n=a,c,t or g
  misc_feature (132)..(132): n=a,c,t or g
tgagtgtcctgaacatctgtgtacantgttctgtcactcgtgttgaaaggcaaggggaagcgagcaccagcgtgtagcaaccgcttcagagcatcccagacccgcctggagggggagccctgagctcagcgngggaggcccagtcggacaccaggaggatccgcaagggggaccctgtaccaccctggaacaaacaaatgagcagggtttgggggccagaatgagactgggggtagtcctaaggtacccctctacttaggtgggcagacaaagaccccatattaaaatacctgcagcctcttcaacctcgggatgattgcaaaat

SEQ ID NO: 101 - DNA, 1909 bp, Rat
gtccatgcaagatgttccttagcactctgttcctggtgtctctagcaacctgtgtgatttgcggaaatccctcttcaccacctgtggtagacactgctcatggtaaagtcctggggaaacacgtgaacgtagaaggattttcacagcctgtggccgtcttcctgggaatcccctttgccaagccccctcttggatccctgaggtttgctccaccacagcctgcagagccctggagctcagtgaagaatgccaccacctacccacctatgtgctcccaagatgcagctagaggacaggcggtcaatgacctcataaccaatagaaaggagaaaatccatcttgaattttctgaagattgcctgtacctaaatatttacactcctgcggacttttcaaagaacagtaggctaccggtgatggtgtggatccatggaggtggactgaagctgggtggggcatcaagctttgatggacgggctctctctgcatacgaaaatgtggtggtggtggccattcaatatcgcctgagtatctggggattcttcagcacaggggatgaacacagtcggggaaactggggtcatttggaccaagtggctgctctgcattgggtccaggacaacattgccaactttggcggggacccaggctctgtgaccatctttggagagtcagcaggaggttacagtgtctcaattcttatattgtccccattgtccaagaacctcttccacagggccatttctgagagtggtgtggccttcattcctggaatgtttaccaaagatgtgaggccaattactgagcaaattgctgttactgctggctgtaagaccaccacgtctgccgtcattgttcactgcatgcgccagaagacggaggaggagctattagagatcatgcataaattgaatctgtataaactgagtttacaaggagataccaaaaatagcgaccagttcgtgacaagtgtgcttgatggagtggtgctaccaaaggaccccaaagagatcctggctgagaagaacttcaacactgtgccttacattgtgggaatcaacaagcaagaatgtggctggcttctgccaacaatgacgggatttctaccagctgatgtaaaattggacaagaagaaagccattgcactcctggagcaatttgcttccatgactggcataccagaggatattattccagttgctgttgagaagtacacaaaaggtagtgatgaccctgatcagatcagagagggagttctcgacgcaatgggggatgtggcatttggtgttccatcggtgattgtgtcccgtggccacagagacactggagctcccacctacatgtatgagtatcaatactacccaagcttctcatcaccccaaagacccaagaatgtagtaggagaccatgcagatgatgtctactctgtcttcggtgctccaattttaagagagggtgcctccgaagaggagatcaatctcagcaagatggtgatgaaattctgggccaactttgctcggaatgggaaccctaatggcaaagggctgcctcattggccaaagtatgatcagaaagaaggatatcttcatattggtggcaccacccagcaagcccagagactgaaggaagaggaagtgactttctggacacagtcccttgccaagaaacaaccccagccataccacaatgagctgtgaatgcaaagctctgccaggcttataccagagaagccaagatatggttcttccactaacagtgtatgtaaatccaagatggatcttggaggatcctgaagaactttgtcatagatataggcagagcccagggaagggaaatgttgtatttatgtctttaatttagagaataaatgttctttatatggtcaaaaaaaaaaaaaaaaaaaaaaaaa

SEQ ID NO: 102 - DNA, 1716 bp, Rat
tcacgatgtggctcttcgatctggtcctgacctccctcgccacttccatggcttgggggtacccgtccttgccacctgtggtggacactgtgcaaggcaaagtcctgggcaagtatgtcagcttagaaggatttgcacagcctgtggccgtcttcctgggagtcccttttgccaagcctcctcttggaccactgaggtttgctccaccacaggctgcagagccatggaacttcgtgaagaataccacctcataccctcctatgtgctcccaggacgcagtgggaggtcaggtgctctcagaactctttaccaacagaaaggacaacattcctctcaagttttctgaagactgcctttacctcaatatttacactcctgctgacttgaccaagaacagcaggctgccggtgatggtgtggatccacggagggggtctggtggtgggcggggcatcaacctatgatgggctggccctctctgcccacgaaaacgtggtggtggtgacaattcagtatcgcctgggcatctggggattcttcagcacaggggatgaacatggccgcggaaactggggtcacttggaccagttggctgcacttcgctgggttcaggagaacattgccaactttggagggaatccaggttctgtgaccatcttcggagagtcggcgggaggtgaaagcgtgtccgttcttgtgctatctcctctggccaagaacctcttccatcgggccatctctgagagtggtgtggccctcactgctgccttggttaagaaagacatgaaggacacagctcagcaaattgctgtctttgctgggtgtaaaagcaccacgtcggctgtccttgttcattgcctgcgccagaagacggaagatgagctcttggaggtttcactgaagttgaaatttttcactcttgatttacttggagaccccagagagagctatcctttcctgcctacggtggttgatggagtgctgctgccaaagatgccccaagagattctggctgaaaagaaattcaactctgttccctacatcatcggaatcaacaagcaggagtttggctggcttcttccaatgatgatgggttacccactctctgaagacaagctggaccagaagacggcttcgtcactcttgtggaagtcctaccccattgctaacatccctgaggaactgactccactggctagtgagaagtatttaggaggaacagatgaccctgtcaaaaagaaagccctgttcttggacatgttaggagatgtggtgtttggtgtcccatccgtgactgtagcccgtcaccacagagatgccggagcccccacctacatgtatgagttccagtatcatccaagcttctcatcggacatgaaaccccagaccgtggttggggaccacggggatgagctcttctcagtcttcggggccccatttttaaaagggggtgcctcagaagaggagataagactcagcaagatgatgatgaaactatgggccaacttcgctcggagcgggaacccaatggggaagggctgctcctcttggcccgcctacgaccagaaggaagggtacctgcagattggaatccccactcagccagcccagaagctgaaaagcaaggaaatggctttctggactgagctcctagccaagcgggcagcagaaaagctgagtcccacagagcacgtcgagctttgaatgggcggctcca

SEQ ID NO: 103 - DNA, 1186 bp, Rat
ggcgggggtgggaggtgagggggaccagcggctgcagattggctagggaacggcgaagcctgggctggagccccgtggtgggaggcgcctggatcactccggcagcggagcggagcagagactgccacctacttggacgaccctagtagcagccggcttcagggaacatcccagccggggcgcacgccgggcagcggggcgccgagcaccgagccgtcggggcaggccgcaacatccagccatgtgggtggcctggagcgcacggacggccgcactggcgttgctgctcggggcgctgcatggggcgccaacacgcggccaggagtacgactactacggttggcaggccgagccgctgcacggccgctcctactccaagccaccgcagtgcctcgacatccccgccgatctgccgctctgtcacacggtgggctacaagcgcatgcggctgcccaacctgctggagcacgagagcctggccgaggtgaagcagcaggcaagcagctggctgccactgctggccaagcgctgccactcagacacccaggtcttcctctgctcgctcttcgctcccgtctgcctggaccgacccatctacccctgccgctcgctgtgcgaagctgcgcgcgccggctgcgctccgctcatggaggcctacggtttcccttggcccgagatgctgcactgccacaagttccccctggacaacgacctctgcatcgcggtgcagttcgggcacctgcctgccaccgcgcctccagtgaccaagatctgtgcccagtgtgagatggagcacagcgctgacggcctcatggaacagatgtgctccagtgactttgtggtcaagatgcgcattaaggagatcaagatagacaacggggaccgaaagttgattggagcccagaagaagaagaagctgctcaaggcaggccccttaaagcgcaaggacaccaagaagctggtcctgcatatgaagaacggggcaagctgcccttgcccacaattagacaacctgacgggcagcttcctggtcatgggccgcaaagtagagggacagctgctgctcacggccgtctaccgctgggacaagaagaataaggagatgaagtttgcggtcaaattcatgttctcctatccctgttccctctactacccttttttctatggggcagctgaaccccactga

SEQ ID NO: 104 - DNA, 1905 bp, Rat
gaggcgccaggatcagtcggggcacccgcagcgcaggctgccacccacctgggcgacctccgcggcggcggcggcggcggctgggtagagtcagggccgggggcgcacgccggaacacctgggccgccgggcaccgagcgtcggggggctgcgcggcgcgaccctggagagggcgcagccgatgcgggcggcggcggcggcggggggcgtgcggacggccgcgctggcgctgctgctgggggcgctgcactgggcgccggcgcgctgcgaggagtacgactactatggctggcaggccgagccgctgcacggccgctcctactccaagccgccgcagtgccttgacatccctgccgacctgccgctctgccacacggtgggctacaagcgcatgcggctgcccaacctgctggagcacgagagcctggccgaagtgaagcagcaggcgagcagctggctgccgctgctggccaagcgctgccactcggatacgcaggtcttcctgtgctcgctctttgcgcccgtctgtctcgaccggcccatctacccgtgccgctcgctgtgcgaggccgtgcgcgccggctgcgcgccgctcatggaggcctacggcttcccctggcctgagatgctgcactgccacaagttccccctggacaacgacctctgcatcgccgtgcagttcgggcacctgcccgccaccgcgcctccagtgaccaagatctgcgcccagtgtgagatggagcacagtgctgacggcctcatggagcagatgtgctccagtgactttgtggtcaaaatgcgcatcaaggagatcaagatagagaatggggaccggaagctgattggagcccagaaaaagaagaagctgctcaagccgggccccctgaagcgcaaggacaccaagcggctggtgctgcacatgaagaatggcgcgggctgcccctgcccacagctggacagcctggcgggcagcttcctggtcatgggccgcaaagtggatggacagctgctgctcatggccgtctaccgctgggacaagaagaataaggagatgaagtttgcagtcaaattcatgttctcctacccctgctccctctactaccctttcttctacggggcggcagagccccactgaagggcactcctccttgccctgccagctgtgccttgcttgccctctggccccgccccaacttccaggctgacccggccctactggagggtgttttcacgaatgttgttactggcacaaggcctaagggatgggcacggagcccaggctgtcctttttgacccaggggtcctggggtccctgggatgttgggcttcctctctcaggagcagggcttcttcatctgggtgaagacctcagggtctcagaaagtaggcaggggaggagagggtaagggaaaggtggaggggctcagggcaccctgaggcggaggtttcagagtagaaggtgatgtcagctccagctcccctctgtcggtggtggggcctcaccttgaagagggaagtctcaatattaggctaagctatttgggaaagttctccccaccgcccctgtacgcgtcatcctagccccccttaggaaaggagttagggtctcagtgcctccagccacaccccctgccttccccagcttgcccatttccctgccccaaggcccagagctccccccagactggagagcaagcccagcccagcctcggcatagacccccttctggtccgcccgtggctcgattcccgggattcattcctcagcctctgcttctcccttttatcccaataagttattgctactgctgtgaggccataggtactagacaaccaatacatgcagggttgggttttctaatttttttaactttttaattaaatcaaaggtcgacgcgcggccgcg

SEQ ID NO: 105 - DNA, 2429 bp, Rat
gctggactgcccactaccctccaggccctatgccgtggcctgtgcttgggaacctgctgcacatggacttccagaatatgccagcaggcttccaaaagctgcggggtcgctatggggacctgttcagcctacagctggcctctgagtcagtggttgtactaaatgggctgacggccctgcgagaggcactggtgaaacacagcgaggacactgctgaccggccaccgctgcatttcaatgacctgctgggctttggaccacgctctcaaggtatagtcctagcacggtatgggcctgcctggcgtcagcagcggcgcttctctgtgtctaccatgcaccactttggcctgggcaagaagtcactggagcagtgggtgactgaggaggccagatgcctctgtgccgccttcgctgaccatactggacaccctttcagccctaacaccctattggacaaagcagtgtgtaacgtgatcgcgtccctcctctatgcctgccgctttgagtacgatgacccacgcttcatcaggctactgggcttgttgaaggaaactcttaaggaggaagctggattcctacccatgttcctgaatgtgttcccgatgctcctgcgcatcccggggctggttggcaaggtcttccctgggaaaagggcctttgttaccatgttggatgagctgctggctgaacacaagacgacctgggaccctacccagcccccgagatttgactgatgccttcctggctgaggtggagaaggccaaggggaatcctgagagcagcttcaatgatgagaacctgcgcacggtagtgggtgacctgttctctgcagggatggtgaccacctcaaccacactgtcctgggccctgatgctcatgatcctgcatccagatgtgcagcgccgagtacaacaggaaatcgatgaagtcatagggcaggtgcagtgtccagagatggcagaccaggctcgcatgccctacaccaatgctgtcattcatgaggtgcagcgctttgcagacattctccctcttggtgtacctcacaagacttctcgtgacattgaactacagggcttccttatccctaaggggacgaccctcatcaccaacctgtcctccgcgctaaaagatgagactgtctgggagaagcccctctgcttccatcctgaacacttcctggatgcccagggccactttgtgaagcctgaggccttcatgccattctcagcaggccgcagatcatgcctgggggagcccctggcccgcatggagctcttcctcttcttcacctgcctcctgcagcgctttagcatctcagtgcccgatggacagccccagcccagcgaccatggcgtctttagggctctgacaaccccatgcccctaccagctctgtgctttgccccgctaagaggatgtatgacatctcactcactgtgcttgctggggtcctaatgtgcaataaagcattttactctaaactaaatcatccctatgagatctcctggctgtaagggacctaggcagccttcccatgagcatccactttccctgcttattctgacttgactatttgaccccagtagaaggactgccctgtcagaaatgataccattcttgcctttacccttcccccactttttccctcaaattgataatgtttatacatagatgccaacgtctggaaggatggccagaagggactgctaagatgtgacagtgtaagttacatagatgaaggaagggcaggacctctctctcctagatgcccccatttcagacctaccacacaaccaagactagctgcttagccagcatcatcacaacgtcttatatggcatccccaaagatgtagagaagtccgggaagctggaaatgatatgcaggttaagtgcctaaggtttcctgttgggtaccacatgcttctctaaaaggctttaagggagtccagaagcaggggtttacctcctaagcttctttgtcaacactaactccatgacccaacagggatactgttgtccaggcccatgcccagtaagaaagtgcctctgtaaccagggttggtaggacctgcaagcttgatgttgaaacaggctcccagaccttagaaagtcctcagaccttagcacagctgagtccatgatggaagtaccataaaactctgcacatagacagcagttcctgtcataatgaaaacaaagacctaatccatcaaattccatagttctgggaaagtccctaaaagtagtaatcttgctttttgacttcgatagttcttctagctaactgttcttgctaactgaagtgtgtcaatacatgatatagttgttggtaaaagctcaccctgagtacagctcaggactatactgggattctgagcacccagtgttgtcaccagccagctaataaagcttctattggcttaaatct

SEQ ID NO: 106 - DNA, 1655 bp, Human
gctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtatgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccccagcctgctcctagcccagaggctctaatgtacaataaagcaatgtggtagttcc

SEQ ID NO: 107 - DNA, 3283 bp, Rat
gaagccttctggcagctcagagcattctgcagcgcagagcgtgagggaaaaagacaaaaccagaaaaagaaaagtcatctccagggctcgatctagcaacgagtctgtagcatgtatagcgtcggacccccgagctgcaacccagaaatgtacactcgtgggaaaccgcttgcaccccagagcctgacccagctgcaggcttcaactctgtaggggacgtgcagctcgtgatccaagcctaggagaaaggacttgctgccggctttcatttcctggctgaagtttctctcgtgggtgcagcgcctgcatcccagggtgatgaggttaggggcccagctgctagaggagccctagtgttcggataggcagctgtgcctctgtgccggccaccttggatgccagtcctctctccaactgctatggacaacgggtcgtgctgtctcatcgagggggagcccatctcccaagtgatgcctcctctactcatcctggtcttcgtgcttggcgccctgggcaacggcatagccctgtgcggcttctgctttcacatgaagacctggaagtcaagcactatttaccttttcaacttggctgtggccgattttctcctcatgatctgcttaccccttcggacagactactacctcagacgcagacactggatttttggagatatcgcctgtcgcctggtcctcttcaagctggccatgaatagggccgggagcattgtcttcctcactgtggtggctgtggataggtatttcaaagtggtccacccccaccatatggtgaatgccatctccaaccggactgccgccgccaccgcctgtgtcctctggactttggtcatcttggggactgtgtatcttctgatggagagtcacctgtgtgtgcaggggacactgtcgtcctgtgagagcttcatcatggagtcagccaacgggtggcacgatgtcatgttccagctggagttcttcctgcccctgacaatcatcttgttctgctcggtcaacgttgtttggagcctgagacggaggcagcagctgaccagacaggctcggatgaggagggccaccccggttcatcatggtggtggcttctgtgttcatcacgtgttacctgcccagcgtgctggctaggctctacttcctctggacggtgcccactagtgcctgtgacccctctgtccacacagccctccacgtcaccctgagcttcacctacctgaacagtatgctggatccccttgtatattacttctcaagcccctcgctccccaaattctacaccaagctcacaatctgcagcctgaagcccaaacgcccaggacgcacgaagacgcggaggtcagaagagatgccaatttcgaacctctgcagtaagagctccatcgatggggcaaatcgttcccagaggccatctgacgggcagtgggatctccaagtgtgttgaatgccattaagacaaacagcccaacaacgaggcagagaaatgggcaatgtgagttaaatctgaagggtggaggacttgaagatgtcccctcccactcttagctgtatctttctcactcaggtagaaatgggatccaccctgcttgaccttttccagaaggttccaaaccggttggttgtgtttaaatactctgatagcaatggtgaaggggcagcgtgtgagtgtgaaggaaaccgtgggtgtcgggttaggaactacctggagcccgtgtcgctttgcatggctgagaaaagcggtatgagcctggctgggtcttgttctagctcggagagagttaacgatctcaataactcgtcggtatttcctggactgaaaaaaatagaaactgcactgagtcaatacacttatttccagctgagcgagaccctttactgcaggacacccggacctagccgttttttttaaatcttccctggggagcctccacacatttcaaggtttgaacatccaggtggcccaggagggcagcaaaaagaatctattctaaccttgctggcgccacgatattttgctgattttaagtggtttcatcctttgtttttcttttgtttgcatttcaaagaagatgctgagggacttgtccacctgatatcagctatcgtttctccagtgggaactgagagcctgtttacggcagcaatggtggggggggggtgcttcctggtatttgggatgggttaattcaagcatggttgttcttcactgcttaatgcatgaatttgagctgaaatcctcccttctcaagtctttgtttaatccacagtatgttgtcccaccctgtccagcatcctcgtctgttttgtctttggtgctgggcattgaacttgggaccttattcgagccaggcaagcactgaccactgaactgcactcccaaaccccttgtgccccttttagctgtagcgttgttagccaacttttgggagaaagcaaagcactagaggtggcagcaacagtttagctcaatgtcctttcatcagtgtctagacttctggtcagccatccgggtctcctattgggggcctccctcaagcacatatgttcccccaaatactacccagaattctcacagctaggtgattctgtgaaagtcccggctgcccctgtcctggagaaggagaaatagaatccgtgttaaccttagtcccactttcaagccacaaaagtggtgacagccattcactctctccagttcccagggtactctccccagggaagggaccttgacatttatgtctaaagacataaattagatgctcctcaaggttgtccctgtggcttcctttgccagaggtgttgaagcctaggtgcgaaaatcagtctgactgcagggctggtgagaaggctcagtaggtaaacaggtctgccgccaagccaccaacctgagtatccctgagacccatgtggtaggagaacaccaaatcccaaaggtggttctgtcctccacctatgttcacgcatgcgcacatgcacgcatgcgcacgcgcgcacacccacccaccaaatacattaatgcaataaaaattttattggctacacggtcaagtttgaatcttagtttaaatgcttattagacatgtgctcgtagggaagactttatttaaccccactcagttttgatgttcagcagggttaatactgatgccaaagggtttgggagcaaattcaatgactgtacactcataagcatgagaaatctgttgttcccaggtctgcccggaagaagaccatgtgcgtgtagtagttgataaataaatagttgctgaacaact

SEQ ID NO: 108 - DNA, 3612 bp, Human
agaggcaggcggcttgtgagacgggctccagagaaaggacctccctgggtctctcatttcctggctgaagtttctcttctcgctgctgtggcagcatccaacccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaagtgagttggctgcattttcttatctgatcacaatggcaggggacagaatgtgcatggagtggagcatgtgtgtgttgggaggggggctaggaactgcacagcccttgtgtaattttcgttgtttgtttttgttttgagacagagtctcactctgtgtcccaggctggagtgcagtggcacagtctcggctcactgcaacctctgcctcccgggttcaagcaattctcctgcctcagcctcccgagtagctgggattagaggcgccagccaacacacccggctaatttttgtatttttagtagagacagggttttgccatgttggccaggctggtctcgagctcctgacctcaggtgatccgcctgccttggcctcccaaagtggtgggatcacaggcgtgagccaccgtgcccggcctcccctgtgtcattttaaatggctaagtaaatgggtatatgtgtttgaatggggcatgttcactctcttaggggctatggggcagttagcagcatttcctatcctctgaccttaaatcattccttatctcagaaaacagaaaccgggctcagtcaatcaatgctttatttcaggccgaatgaggctctttagattgggatctattgatctatcaattttcatctttacatttctttgtacatctgtacattttgtccaaatgtacatctgtacgtctgtcatcattgtgacttcctggtagcccaagaagaacaacaacaaaacaatctgctctgaccttcttcaaatctttgtatttcaaagaaggtgctgagggatctgtttccttgccctggcttctccagtgggatgtgctgagtccaatacaattgcttttataattgcttttgacaacttgtcatgtgactgtgaattgaaattattcacttattttccaagtatttactgaattcgtatttggtggcaggcagtatactgtgtaatttttagtggagggtcattagtcaactcttatgtgacagtaaagttttttgggggggtggggacagagaagttaagagctttcatcctttcacggaatacagtttctagaccgattctgtgtgaacatcagttttgtcctcttattgcaagactccctcatacacatgagtttcccaaatgtgtacctggacccctcgaaacagaggactctacgaaatgacaggctgcccctgccctgaattagggggaaacattccaggccaactctagctcctttctcaagctacaaagtggtgaacatggttctcaactccttaatttatactctctcaaatgcccaggatactctacccacttaagaaccttgccaacttctgggggttgggcatggtggctcgcgcttgtgatcccagcactttgggagactgaggcggatcacctgaggtcaggagttctagaccagcctgaccgacatggagaaacctcgtctctactgaaaattcaaaattagcctggtgtggtggcgcatgcctatagtctcagcctccagagtagctgggactgcgggcgccccaccaccacgcccggctaattttttgtatttttagtacagacggggtttcattgtgttagccgggatggtcttgatctcctgacttgtgatccgcctgcctcggcctcccaaagtgcttggattacaggtgtaagccaccgcaccccgcccagcctggcagattttatttaatcatttgtagcttcattttcctcgtctgtcaaacagggatactgtaatacaacctcagtgtgtcattgggcagtttaaatgaatgtacattcctgaggcatcagaactttgttcactgttatatacccaatgcctagaagaggacctgcacatagcaggtgctcagtaaatgtttgttgaatgaatgattaagtgcatgtaaagcattaagcatagcgcctggcagtaagtgctcaatattatgacttcttatattaacacgttttacatataaagaaatggaggcaagaaagcatttcctttggggtttagagcgcttaagttgttcctctgttatcatgcctgaattcccccgcccctcagttacctggggaagagtaaaggcaagaattcttaccagcattagtcatacatcctcctgatagg

SEQ ID NO: 109 - DNA, 3122 bp, Rat
gccctgaaaaaccttcgctgtcccagagaggtcgcgcgctctggcttcgccatgctcctgctgctagggctgtgcttggggttgcccctcttctcagagtcccaggaagaggcaaggagttgggacgacacctcggagcaagtcgtgctcagggtccccaggcagctcaggctgttgcaaagactgaaaaccaagcccttgatggcagagttttcggtgaagtctaccatcatttcccgctatgccttcaccacggtgtcctgcaggatgctcaacagagcttctgaagaccaggaggctgagttccagatgcagattccagaatcagctttcatcaccaacttcaccatgcttataggagacagcgtgtatcggggtgaaattacacagaaagataagaaaagcagtgagagcgtaaaagataaaaggaacagaacctcagacgataatgaagaaaacgggagtgacatgttcaaagcgtctttagtgattcccagcaaggacaaagctgctttcttcctcagttatgaagagcttctgcagaggaggctggggaaatacgagcatagcatcagcgtgcgcccccagcagctggtggggaggctgactgtggaggtggacatcctggagcgatcgggcatcacatccttggaagtgctgcctctccacaacagcaggaagaagggtagtgggaaggcagaaggtgatgtgggtcctcccccttctactctcatcaaccaaaatgagacatttgccaaagtcatctttaagcctactgtggtccaacaagctaagattgcccagaatgggatcttgggagatttcatcgttcggtatgatgtcgagagagagcagaacattggtgacatccaggttctgaatggttatttcgtgcactactttgctcctaaaaacctccctcctctacccaagaacgtggtcttcgtgcttgacatcagcgcttccatggtgggagcgaaactccagcagaccagggaggctctcgtcacaattctcaatgacctccgaccccaggatcgcttcaatatcattgggttctccaatcggattaaaatgtggaaggaccacttactaccagtgactcctgacaacattaggaatggcaagatctacatgtaccatctgtcacccactggaggcacagacatcaatggggcccttcaggctgccatcaaactgctcaacaactacgtggcccagaatgacattgaagaccgaagtgtgtccctcatcatcttcctcaccgatgggaaacccacctttggggagaccaataccctcaagattctcagcaacaccaaggaagccaccagaggtcagatctgcatcttcaccgttggcattggcgatgacgtggacttcaaactgttagagaaactctcgctggagaactgcggtctcacgaggcgtgttcatgaggaggacaaggcgggcgcacagctcatcgggttctatgatgagatccggaccccgcttctttctgacatccgcatagattatcctcctgacgtagtagagcatgccaccaagaccctgttccctaactacttcaatggctctgagatagtgattgcagggaagatggtggacaagaagtttgatcaactgcatgtggaggtcactgccagcaacagtaagaaatttgtcatcctaaaaagagacatccccgtggagttccggaagatggggaatgatgtctcagtcacacctggctcagccagagatggcgggaaggacctaaaccacattgagcgactttggagctacctcactgtgaaggagctgctaagctcctggaggcagagcaacagtgagcaagagaaagagcagctgaggcagaaggcccaggacttagccttgaactatcatttcctcacccccttcacctccatgaagctgaggaagccagggctccgcacaaaccagctggaggacacctatggcatgtctgcagctacaggacctgcgaccgtggtgcagaaccttcgagaggccggcaagcagccagaacctgatctcaaaaaaacatatgacccaagaattaaaatctctaaaacatcagtggatggtgatcctcattttgtagtggatttccccctaagcaaactcactgtctgctttaacatcgacggagagccgggggacatcctacgtctggtctctgatcatctgaactctggtgtgactgtgaatggcgagcttattggggcccccgcacctccgaatggtcacaagaaacagcgcacctacttccgcaccatcaccatcctcatcaaccggccagagagatcttacctggagatcacaccaagcagggtcatcctggacggtggggacaggctggtactcccctgcaaccagagcgtggtagtagggagtcgaggattggaggtgtcagtgtctgccaatgccaacatcaccgtggtcatccagggcaacattgcctttgtcatcctcatccacctgtacaaaaacccagcacccttccagagagaccacctgggcttctacatcgccaacagcagaggtctctccgacaactgccacggactgctaggtcagttcctgaaccaggatgccaaacttgtaggagctcctgaggaatacggcaagaatcttagtaaccagccatttcctcgggcagaagggatgcctgaggctatcctgaaggtgaaagggcgccgagttccagtggtctggaaacaaaggaagatttacaacgggcaagcacaggtagactgctggtttgacagaaacaatgctgccaagctgattgacggtgtctataaggactacctggcatctcatccgtttgacacagagagtgcactgggcctgagcacgcccaggaaacctgagaccgacaggccccatgaggagagtgtctaaaagggaagggatattgggtctactctggacgcaactctttttatgtgtggctaccttggctcttgctatgcgctgtactgtgtagcccgccccctggtgagctggaggtccaatgtctcttagagcaatgagtcagggcaggaagctgaaatgcaaatacttcccttcctgccttcctcatctatactagataaaaaaaaaaacaaacaaac

SEQ ID NO: 110 - DNA, 277 bp, Human
  misc_feature (36)..(40): n=a,c,t or g
  misc_feature (43)..(43): n=a,c,t or g
  misc_feature (48)..(50): n=a,c,t or g
  misc_feature (52)..(53): n=a,c,t or g
  misc_feature (57)..(58): n=a,c,t or g
  misc_feature (60)..(67): n=a,c,t or g
  misc_feature (69)..(73): n=a,c,t or g
  misc_feature (75)..(75): n=a,c,t or g
  misc_feature (77)..(77): n=a,c,t or g
  misc_feature (79)..(81): n=a,c,t or g
  misc_feature (178)..(178): n=a,c,t or g
ctaagctcctggaggcagagcaacagtgagcaagannnnnagnagctnnngnngaanncnnnnnnnntnnnnntnancnnncatttcctcgggcagaagggatgcctgaggctatcctgaaggtgaaagggcgccgagttccagtggtctggaaacaaaggaagatttacaacgggcnaagcacaggtagactgctggtttgacagaaacaatgctgccaagctgattgacggtgtctataaggactacctggcatctcatccgtttgacacagaga

SEQ ID NO: 111 - DNA, 1938 bp, Rat
gagagaggaggcaggtgcctgcctgcacaggcaaagcctgcagacagtggctggaaccaggatggacaagaagaaagagcacccagagatgcggataccactccagacagcagtggaggtctctgattggccctgctccacatctcatgatccacatagcggacttggcatggtactggggatgctagctgtactgggactcagctctgtgactctcatcttgttcctgtggcaaggggccacttctttcaccagtcatcggatgttccctgaggaagtgccctcctggtcctgggagaccctgaaaggagacgctgagcagcagaataactcctgtcagctcatccttgtggaaagcatccctgaggacttgccatttgcagctggcagccccactgcccagcccctggcccaggcttggctgcagcttcttgacactgctcgggagagcgtccacattgcctcgtactactggtccctcactggactggacattggagtcaatgactcgtcttctcggcagggagaggcccttctacagaagttccaacagcttcttctcaggaacatctctgtggtggtggccacccacagcccaacattggccaagacatccactgacctccaggtcttggctgcccatggtgcccagatacgacaagtgcccatgaaacagcttactgggggtgttctacactccaaattctgggttgtggatgggcgacacatctacgtgggcagtgccaacatggactggcggtccctgactcaggtgaaggaacttggtgcaatcatctacaactgcagcaacctggctcaagaccttgagaaaacattccagacctactgggtgctagggactccccaagctgttctccctaaaacctggcctcggaacttctcatcccacatcaaccgcttccatcccttgcggggtccctttgatggggttcccaccacggcctatttctcggcctcccctccctccctctgcccgcatggccggacccgggatctggacgcagtgttgggagtgatggagggtgctcgccagttcatctatgtctcggtgatggagtatttccctaccacgcgcttcacccaccatgccaggtactggcccgtgctggacaatgcgctacgggcagcggccctcaataagggtgtgcatgtgcgcttactggtcagctgctggttcaacacagaccccaccatgttcgcttatctgaggtccctgcaggctttcagtaacccctcggctggcatctcagtggatgtgaaagtcttcatcgtgcctgtgggaaatcattccaacatcccgttcagccgcgtgaaccacagcaagttcatggtcacagacaagacagcctatgtaggcacctctaactggtcagaagactacttcagccacaccgctggtgtgggcctgattgtcagccagaagacccccagagcccagccaggcgcaaccaccgtgcaggagcagctgaggcaactctttgaacgagactggagttcccactatgctatggacctagacagacaagtcccgagccaggactgtgtctggtagggctgagggttgatccctttgattctggcctacagctctagatggacactgatgctccccagacttccatctgcccaagctcagaaaccaagcaagcaaaggatcaccactgagggcccgagattgtcatcagacaaacagcttccggcagagctctcaacggcttttaaacgaagaagaggctaaagcagagggaggcaccacggtgacatgggaagacagcaactacatataagtgacccccagaaccctccctggtctacctatgatgagttgctagggccattcccagatgtaatgttggtgctgtccagccacaataaaaccctgccaccagctactgacctgacccaggtcaaaagtgt

SEQ ID NO: 112 - DNA, 1929 bp, Human
ggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcaaaaaaaaaaaaaaaaaaaaaaaaaaaaaaaa

SEQ ID NO: 113 - DNA, 1248 bp, Rat
atggtggaccacctgcttccagtggacgagaccttctcgtcaccgaaatgctcagtgggttacctaggggacaggctggccagccggcagccataccacatgttgccctcgcccatctcggaggatgacagcgatgtctccagcccctgctcttgtgccagccctgactcgcaagccttctgttcctgctacagtgcgggtccaggccctgaggcccagggcagcatcttggatttcctcctgtcccgggccacactgggcagtggtggtggcagtggaggtattggagatagcagtggccctgtgacctggggatcatggaggagagcctctgtgcctgtgaaggaggaacatttctgcttccctgaatttctgtcaggggacactgatgacgtctccaggcccttccagcctaccctggaggagattgaagaattcctggaagagaacatggaggctgaggtcaaggaggccccagagaacggtagcagggacctggagacctgtagccagctctcagctgggtcacaccggagccaccttcatccagagtctgctgggagagagcgctgtaccccaccaccaggtggcacgagtgggggtggtgcccaaagtgcaggtgaggggccagcacatgatggccccgtgccggtgctactgcagatccagcctgttgctgtgaagcaggaggcaggtacagggccagcctccccagggcaggccccagagagcgtcaaggtcgcccagcttctagtcaacatccaggggcagacctttgcactcctgcctcaagtggtaccatcctccaacttgaacctgccctcaaagtttgtgcgaattgcgcctgtgcccattgccgccaaacctattggctcaggatccctagggcccggccctgctggcctccttgtgggccagaagtttcccaagaacccagcagcagaacttctcaaaatgcacaaatgcactttcccaggctgcagcaagatgtacaccaagagcagccacctcaaggcccacctgcgtcggcacacaggcgagaagccctttgcctgcacctggccaggctgcggctggaggttttcccgctcagatgagttgtcaaggcaccggcgatctcactcgggtgtgaagccgtaccagtgtcccgtgtgcgagaagaaattcgcgcggagtgaccacctctccaaacacatcaaagtgcatcgcttcccacgaagcagccgcgcagtacgcgccatcaactga

SEQ ID NO: 114 - DNA, 1251 bp, Rat
atggtggaccacttacttccagtggacgagaacttctcgtcgccaaaatgcccagttgggtatctgggtgataggctggttggccggcgggcatatcacatgctgccctcacccgtctctgaagatgacagcgatgcctccagcccctgctcctgttccagtcccgactctcaagccctctgctcctgctatggtggaggcctgggcaccgagagccaggacagcatcttggacttcctattgtcccaggccacgctgggcagtggcgggggcagcggcagtagcattggggccagcagtggccccgtggcctgggggccctggcgaagggcagcggcccctgtgaagggggagcatttctgcttgcccgagtttcctttgggtgatcctgatgacgtcccacggcccttccagcctaccctggaggagattgaagagtttctggaggagaacatggagcctggagtcaaggaggtccctgagggcaacagcaaggacttggatgcctgcagccagctctcagctgggccacacaagagccacctccatcctgggtccagcgggagagagcgctgttcccctccaccaggtggtgccagtgcaggaggtgcccagggcccaggtgggggccccacgcctgatggccccatcccagtgttgctgcagatccagcccgtgcctgtgaagcaggaatcgggcacagggcctgcctcccctgggcaagccccagagaatgtcaaggttgcccagctcctggtcaacatccaggggcagaccttcgcactcgtgccccaggtggtaccctcctccaacttgaacctgccctccaagtttgtgcgcattgcccctgtgcccattgccgccaagcctgttggatcgggacccctggggcctggccctgccggtctcctcatgggccagaagttccccaagaacccagccgcagaactcatcaaaatgcacaaatgtactttccctggctgcagcaagatgtacaccaaaagcagccacctcaaggcccacctgcgccggcacacgggtgagaagcccttcgcctgcacctggccaggctgcggctggaggttctcgcgctctgacgagctgtcgcggcacaggcgctcgcattcaggtgtgaagccgtaccagtgtcctgtgtgcgagaagaagttcgcgcggagcgaccacctttccaagcacatcaaggtgcaccgcttcccgcggagcagccgctccgtgcgttccgtgaactga

SEQ ID NO: 115 - DNA, 3484 bp, Rat
cccagaagagtttgaagaactcgtccgtgcctatggcaacatcgagagatgttttttggtctacagtgaagttactggccactccaaaggctacgggtttgtggagtacatgaagaaggactttgctgccaaggccagactggagctactgggcaggcagatgggagcctcggcgctcttcgcacagtggatggatgttaatctcttggcctcggagctcatccattctaagtgcctttgtatagataaactccccagtgactacagcgattcggaagagctcttgcaacttttttccggtatccataaacctgtgttttgccagcttgcacaggatgaaggaagtcacggtggtggctttgcggtggttgaatatagcactgcggagcatgccgaagaggttcagcaggtggcagatggcatcaccatcaaggggagccaagttcaactgtccttctgcgccccaggagcaccagggcgaagcactctagcagtcctcatagcagctcagcgcgcgatgcacagtaatcaaaagggattactgccagaacccaatccggtacagattatgaaaagtttaaacaaccctgccatgttacaagttcttctgcagccccagctatgcggacgagccatgaagccagttctcggagtcgcgcccagcttatctcacctgctgagtccgtcactcccctccgccatcttacacttcagtaaagcacagcagagctcagctgtgggtaatacatcgtccttaatccttcagaacctgtctcccttgcccttgatacagcaacagttgatgaagtttgacaatgcccacactaacaataagcctggcttgctgggagagcctcctgccatggtactgcagcctgctctggcgatagggccaccgcttccactgaaaacggacctgggacaccatggcgaagcacacaaaacatctaacctgattccacctcagacgacattggcagccgggctgggcatgctgccgttcttctcaaaccagctccctgctggacaagccggcccggggcgtgggaccactcaggagaaacagtccgcttcggtgagcattagcgaagctagcttctcagggtcgcagcattacctgcagaccttcccaggccttcctgctggaggcccgctgacgggcaaccagaagacaccgcagagccagccaaaaggcacagaggttgcctctaagaatcagacttcactcttgggagaaccaccaaaagagatccggctcagtaaaaatccatatttgaatttggcaagtgtgctacccagtgtgtgcctatccactgcaggtaaaggcatgcctccgaagactggaattgcgagcaacattctggatgcgatctctcagggaagtgagtcccagcatgcactggagaagtgcatcgcctattctccatccatcgaggattatgcccaggcatcctccttgaggaatgagaagcgaggctcctcctatctcatctctgccccagaaggaggcccggtagaactcgctggccagcaccctcaggacaccggagtgagctacacagaaacctacttgaaaaagaagcgtgtgtactaagctccgggtctcctgcccgcctgctgcggcgcggcgcctgctgctcatcgctgccttaacttcattcacactagccatatcctttctatacgggtgtctgacttcccagaaggaactgtcatgcagcaggcagatcagccaaatacccacctagcaataagaaacaccactggtcgagggcatttccactagcattagatgtgtcttaatccacgtgataaggactccgctcacaggagagtcagcattccaatagtccttgtttcgggcctgggaacaattttgacatcatatataaagtctgaagcaataactgggaaactgttgtttccttagccttagaatgaatttcgtataagccaatgtgcatttaccttactctcccctaaaaatagtctcatctgtagtctttcctcaaactgcaagggtggcagtaccacccagtggtgacaacagatgctcatcatgcagcctccattagctctacaaagccacataagaccaacccagtggcagagtgaaagtgatgtgacttcagatgcttcacttccggagtatcatttaccatatacaccttttgcggaaaacaaagtatttcaggaaaagtaacttttgtacataatacaagggttagcagaatacacactagggccacatgtagtccaccacctagctttgtgctgcctgtgaatcaagtgaggacatttctaaacgtctgggggtaggggaggacttacaacatgaaactgcagtttcaatgtccccaagatgatgttgggaacacagtgaggcttgctcatttacatattatgtagttacttttgtgtcacaatgggaactgagtagcctcgagaaccacagagcctgcaatggcaggggcgtttactctcttgcccttagtctgtctccctattctttttatcttatgggagatgtgcatagcaaggagccagggtttccctgccgtctcatagcatacagcagtgaaggtctcgtccctagacagggccgagccccagcagagcagtgcacacagcccttcctgagggaggccgtggacagcgtggggcagttctgagctaacaggctctacctcactctggttatttactcactctttggtagttgttaagctgaaaggaaatggccgcttaatccaattcacttctgaaagaacacttgtctttatttgtctgacttttgacttcaccctttgccgaagatcttggtattaagtgagcaacctttttccatctagaaatttctatgtgttcattgttaagagactacaactgatgaagtgtaggatctcaatgatcctagatcagatcattaaaaaaccttatttggaggacttatcatttttgactgataatgctctccagcattaattataaaatctaaaactggtacatatgttacatgttttataatgaattttacctggcctaatttattgcatataccagctttcattgaaaaaatgacagctaaaaaatgaaaggaagaccgtcctagacacgcttcctataggtgatgaccagcacgaggtcccagcagatgactaatggtgtgctctgaccctgcacctcctgcctctggctgcagctctaagtcacagaatagtggaggctagagactgctatctgggagctgcagtgtgaggaggaagcagtggagggaacttagagacacttcacattccatgtgggtcctccactatgccagcctgtgcccgttattacaagacagaaatgcaaatcaagtgatgttagtacaaggtcattacaaccaaccccccaaagtctacgctgttagttttctgtgtcagctaatggtttgaaatgcttttcaagatgcaagcttaatattaaaaggcatatgcatgtg

SEQ ID NO: 116 - DNA, 4352 bp, Human
cccgggcctcctcccgctttctctctccgcttcccctggagcctccgaggagtccgcagccgctgggcgcccgggaagatggcggcggcggcgggagacggcggcggcgaggggggcgcgggcctgggcagcgcggcggggctggggccggggccggggctgcgcgggcagggcccctcagccgaagcgcacgagggcgccccggacccgatgcccgccgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaatccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatgtccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattgggacgttgccatgctcattcatttacgtgttgtctgtggcactcttacgctacaagggcagaactgattagcttcaacagagactgtatggcctacaaagaccatatggcctaaaatttcaagtatctggccatttatatatagtttgctgatccctgatctaatagcactaattctaatagcaactattcctttcaattcacctaaagacagacctttagcctttagacagacttgtaagtggaaaggaacatgggtttctgtgctcatttcatagcgtagactagtaatgatctaatgactagaatggggcctattttgatcactaaatgccctatttccacaatatagtatagtaaagcagtcaatactgcactttctgatggagtcttaaggagtcacagtatttataaccattttgagctaataagctatacctcactctctgctttctctctctctctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgtttgtagtaaggaccgtaacccaccccttcctccccccaaaactatactgttatttttctatgtaagcaaattgtttgaaatgctttgaaaatgaaatcttaatattaaaaggcatatgcatgt

SEQ ID NO: 117 - DNA, 1617 bp, Rat
tagcagatggttggcattttaaatacatcacttttaagcatcttgtagcataagactacagtctgcagtgtttcagcctcgttagcttagtcaaccattttgtgttccatatttgaggaaggccttatcatttacttgacctatggtcagtcttggggtggaagtggcataagggtctaaatgagagacaattactagtgccagttatagtatttatactttgaggattttggatggtcttcatggtgtatcctttataaatgttgaaatctatcccacttgaacctccacccaactcagttttcccatactcattgcagaactgacccaactttcacagaaataagcacacatagaccattaatatttaaagtttttactacttgtaagtacatgaaatacagaaattaacaatattaacaaacatcagagaagttacagaattacaagagatcataaaaggactagtaaatagttccctggtcatcattcagttacactgagggcgtgttctgatttatagcctcttctcctaactcccttcttcagggttcactcatgggaactgctgaccaatcttagctgggttgggtgctagactaggctactcagactctggcacgaggtagattcatgttggcaccattgctgagtctgaatccaaggatgttccctttgatccagtggaactgtttgtgttgtacagccacttggatctgtaactgtaaccctgggtgggaaggaaggcactttcctatctggactctgacatttctcctttgagcttttggtaatctgtctttaaacttaataactttgtttattcctttgtaaaatcctctcaacttccatttccttgtggtttcactttattctctggtcttctgatatatatgctagacagtatttaaactttctgttctctcaagtaaagctagttttgtttgctactgttccaaatttatatctgggtccagccttaatgcagctctatgtctttgctatcatcctgggagactctgttttttccaatagccatctttcattgcttcagaattcttccacaatcactgtacttctcactaaacttgtgtgttattaatttttaagggatgccattaatttacacttaattacaataggaagcaaatctgaacccattgaaaactccagcccttcccagttgagattactagctcctcagtatatactcaatactagctcctcaggtggactctgatattagataactcaggggacccacaccccagggaatgggattaaaagaataagtacagttttacaataccaaaatacacaaaacaacgatattgaaattacagcagttacatatagggaaacaatagtaacattaaacacttccaccaagagagggagaatagatcatcacctcagctctcttcactgagaggtaacttcttaaaacagatcttacatgttattagcccagaggtttgaatgtttgctctgctggctatggactatttggcttttgtttgtgaaaatttggcaattagagatgtttctttatgttagatttagagggttttctgatcagtggcataatgtggctataaactccaatcttgtttcacc

SEQ ID NO: 118 - DNA, 1372 bp, Rat
ggtggggactatataaagccaccttcctggggtcttgaggacagacatagaggagcagctatggtctcttggcagcatcaaggaagcctccaggatctcaagacctgccttgccagaaccctgtttctcctggccctcttgggcagggtgtccagcctcaaggaatgcctgatactgcagtcggctgagggtagcaccgtctcctgccatggtcccaccgagtttccgagctccctccctgccgacactgtccatctgtcggtggaattctccaacctgacgcagctgcccgccgccgccctgcaagggtgtccgggtctgcgggagctgcacctctcgagcaatcgcctgcaggcgctgtctcccgagttgctggcgcccgtgccccggctgcgcgccctggatctgacccgcaatgctctccgcagcctgccccccgggttgttcagcacctcggccaacctgagcaccctggtcctgagggagaaccagctgcgggaggtgagcgcgcaatggcttcagggcctggacgccctgggccacttggacctggcggagaaccagctgagttcgctgccctccgggctcctcgccagcctcggcgccctgcacaccctcgaccttgggtacaacctgctggagtcgctgcccgagggactcctgcggggcccaaggcggctgcagcgcctgcacctggaagggaaccgactgcagaggctggaggatagcctgcttgcgccccaaccgttcctgcgcgtcctgttcctgaatgacaaccagttggtcggggtggcgaccggctccttccagggcctacagcacctggatatgttggatctgtccaataactctctgtccagcacgcccccgggcctgtgggcgttcctggggaggccgacccgcgacatgcaggacggcttcgacatctcccacaacccctggatctgtgacaagaacctggcggacctttgccgctggctggtcgccaaccgaaacaagatgttctcacagaacgacacgcgctgtgcggggcccgaggccatgaagggtcagcggctgctggacgtggcagagctggggtccctgtgaggatgatggctggggtgctggccaagggcaccccgctcgccactgagccaatgtggtcccatgtcagtgtgcagattcctcattccctcagccaggaatgctattctcggactccctctctgggtcctctccactcgccacaactcttccacctctcactcttcctgtgccggcccccaggccaccttgtgtttatctggctttgacacgtctgtttcaggggtcaccaaagcagttaataaaacggctcctaggctgactgaaaaaaaaaaaaaaaaaaaaa

SEQ ID NO: 119 - DNA, 413 bp, Rat
  misc_feature (109)..(109): n=a,c,t or g
  misc_feature (114)..(114): n=a,c,t or g
  misc_feature (166)..(166): n=a,c,t or g
  misc_feature (274)..(274): n=a,c,t or g
  misc_feature (286)..(287): n=a,c,t or g
gtcctgttcctgaatgacaaccagttggtcggggtggcgaccggctccttccagggcctacagcacctggatatgttggatctgtccaataactctctgtccagcacgnccccngggcctgtgggcgttcctggggaggccgacccgcgacatgcaggacggcttngacatctcccacaacccctggatctgtgacaagaacctggcggacctttgccgctggctggtcgccaaccgaaacaagatgttctcacagaacgacacgcgctgtgcngggcccgaggcnntgaagggtcagcggctgctggacgtggcagagctggggtccctgtgaggatgatggctggggtgctggccaagggcaccccgctcgccactgagccaatgtggtcccatgtcagtgtgcagattcc

SEQ ID NO: 120 - DNA, 2468 bp, Rat
ggcacgagggcagcagcttcccttcctactatccgctgaaggcccagctgttgcagaggctgggaaaagtgagtccattccgtggggaatcgcgttgctggaatcaggatcagaggctgagttgaagttgcccctcccccatgtcaactgacgaacacctggacccgattcctgacagcttcatcctgcagccgccagtcttccacccggtgattccttatggcacaacaatttttggtggcctgtatgcaggcaagatggtcacgctgcagggtgtggtccctctgcatgcaaggaggtttcaggtggacttccagtgtgggtgctgcctgcatcctcagccagatgttgccttccgcttcagccctcgattctacactgtcaagccccatgtcatctgcaacacccaccaaggtggactctggcaaaaagagatccggtggccaggggtcgccctgcagagaggggatagcttcctcattctctttctctttgagaacgaagaggtgaaggtgagtgtaaatggccagcactttcttcactaccgctaccggctcccactgtcacgggtagatacccttgacatatctggtgacatcttggtaaaggctgttggattcctgaacatcaatccatttgtggagggtagcagagagtatccagttggatatcccttcctgctgtatagccccaggctggaggtgccctgctcacgtgctcttcctcggggtctctggcctgggcaagtcattgtagttcgaggactggtcttgaaagagccgaaagattttaccctgagcctgaaggatgggaccacccatgttcctgtgacactcagggcttccttcacagacagaacactggcctgggtctcctcctggggacgaaagaagctgatctccgcccccttcctctttcacccccagcgattcttcgaggtactgcttctgtgccaagagggagggctgaagttggcactcaatgggcaggggctgggggccaccagcctggaccagaaagccctggagcagctgcgggagctcaggatcagtggaaatgtccacctctactgtgtccactgctaagaagggctccaagggcacccccgccagagaagaggaggggcggctgcaaccagggctccacagttacagcccattctcctattctcaagggagaaactgacctggcatcactttgtcaggccgagctcacatctcaaagggcgcgcgcacacacacacacacacacacacacacacacacacacacacacacacacattgcattttaatctatcaattctgaaaataagggcccaggtcaatgtgtctctgcatctatcttccacattcaaattctgtcttggtcttcattccaatccaggcccagccactgagaaggcaaatagagtgtgaacaagatgagccccaaatctgtgatcaacacacaccatctacactcaccttttcatctacacttgttttatctacagtcactcactagtttgtgaagcctttgcccaaagtgaacaaaatatcacagctgctttcatggttttggccaaagggaaccagccacatcctaggaaaacacactgattatgggaccttttggtcacccaaccatgtaaacaacaataatctctcataaaattaatctataatatagtctgggtgggccagggattattcagtctatgtttctacagcataccctgcaatatctatacaatggccaaatggtcaaacaatgcatttcccagaatttgtccttgtcatgaaatgatacatgactgtatctagcagagcaggtagaccaggaaaaaggaagctgtagagtgtttgatttgaactattcctggaaatgaagtctgggctcactttaaatctaaagtgacttaagactctgtctcctgggaatgtttctgtaatcccatctacctgcccagagctgtgcccgggtacacactgtagaagatactgatgaaggatttgctgtgttctaacattatactctaagcaaagagccgttttcttcccttgtccatttaccaagattgatcatgtacctttcataaaggaaaaaaaaaccctcaaatttccaaggggaaagtttttactgcaaatatatgtctttattgtaatccagggaaactagaggtcagaaaaagaggtggctgagaggcatcccctagacaccaaagcccggaactctaggaagaatctatgtcaaagaagagatggcaggttggtggttgaggttacttagttaaccttctaatgaaataaactatattgagaatctctaatatatatcttagtatactatactaaatttagggaataaaatttatttggtgttgattaatcttaataaaaatacagtgtacattttatccactgatattatgtatcttatgttcataaattaaattggcttgtcattctaaaaaaaaaaaaaaaaaaa

SEQ ID NO: 121 - DNA, 1647 bp, Rat
cacaggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaaaaaaaaaaaaaaaaaaaaaaaaaaaaaaa

SEQ ID NO: 122 - DNA, 2701 bp, Rat
gagagggggcttagtcccctgtgactgaggactggtggctggaatccccagcctgagtctggctgttcacactggctctctgtatgtcttgcagcctgtgacactggggtccagggcagaatggcccaggccctgggagaggacttgttatcagaactacaggatgattctagctccctagggtctgactcagagctgagtgggcccagtccatatcgccaggctgaccgttatggcttcattgggggcaactcaggtgaactgaggctttgtcaaccctctgcagacctcatccgccagcgagagatgaaatgggtggaaatgaccttacactgggagaagaccatgtcccgacgatacaagaaggtaaagatccagtgccgcaagggcatcccctcagccctgcgtgcccggtgttggcccctcctgtgtggggcccggatgtgtcagaagaacaaccctggcacctaccaggagctggcagcagcccccggggacccgcagtggatggagaccattggcagagacttgcaccgtcagtttcctctgcatgagatgtttgtgtcaccccagggacacggcaggggctgctgcaggttctcaaggcctacaccctgtaccggccagagcagggatactgccaggctcagggacctgtagctgctgtgctgctcatgcatctacccccagaggaggccgtacagctggatgctgaagtgttcatggcccttctgaggcggcagctcccacgagtgtacaagcacctgcagcaggtaggcgtcggccccctgctctacctgcctgagtggttcctgtgcctcttcactcggtcgctgcccttccccacagtactgcgcatctgggatgccttcctcagtgagggggctaaggtactgttccgcgtggggctgacactgatgcgcctggcactgggcactgtagaacagcgcacagcatgcccagggctcctggagacattgggggccctacgagccattccccctacccagctgcaggaagaggtcttcatgtcccaggtgcacagtgtaaccctgtctgagcgagtcctgcaacaggaaatcaggatccagctagcccagctttcgaagtcactccctgggccagcccctctgccacaggcccgccttcctggggcccaagccatcttcgagtcccagcagctggcaggggttcgagaaagcaccaaacctgagatacctcgaattgtggtgcagcctccagaggagcccaagccaccacggcgcaagccacagacccggggtaagactttccatggactcctgataagggccaggggaccccctattgagggcccctccaggtcccaacgaggctctgcctctttcctggacacccgattctaagtgcaccatacacttagtgccaccatatctcaatcatctgagcagtgatgccagccccaggcatgtatcctctattgctgtgctatgtgacaatgctgtttccagcaaggaccaccgtgaggagtggagtgtctcctcactttaaggactgtatcaggcacaaagataaagaaggatgctgagtggagcttgtggggagctgtttggtgcttgccattgccagcatcaaagccagcactgaaggattgtgggaataaagcctctggctgagatatggtaccccatgggcttcttgcaagggaatcctcaaataaagcctgactgagaagatactagataaagttggatcaaatattcctccactctccaccctggccttattgctgtgttctctcctgcctgcatccaccctttctgtccttgtcccacatgggacacaccaaggctgcccattggttactgtgtaaggtgtttacagggaaagggagcccgcccgcaataagccagcttgcgccagcctctagggtacaggtcagacttctctaccttccagaggaaggctccccagtgacagctgagtcccagagaggcacttcaacctcccatagcctcccctagatggctcagggctcccatcggtgggggactttaaaccatgttggcctccctaaccatgttcctgctcccatctgtcaaagagagccagagaagaacaaaggcctagtgtgctcaggacaaaggagaaaggtcctgctggcccttgttcttccctaggtccttgggaccgccaccatagaaaccctctcccacactcactaattgctcctgtgggtgcctagggtgcctgggatatgagccattgtcaaggcaacagggctagatcagatgctagcttgtctctacagagttgagtcctagttgctctggctctctgactccctgggtagcttcccagcgcctgaaggtgggagcaaggcaagagctgggaaggagtatttggaggcccttctttccatgggaaccatgcagtggtggaggcaacagaagtggactgagcagagcaaaggtgaagagggagatgctccactggaggagaaaggggcagtgctgagccagagagagaccagcatttccactcctgtgcctaaggaaggaaggaaggaaggaaggggcacatgttacaatgttctgagacaatgggctaagacctgctagtcttcatggctcaccagcatgtctttttaatttttaattttttaatatgatttctccccgtgtaattttttttattttttaatacaatttttaatatgtgc

SEQ ID NO: 123 - DNA, 1570 bp, Human
ggaggaggaggaagtgagaggaggaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacggcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgctgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaaaaaaaaaaaaaaaaaaaaaaaaaaaaaaaaaaaaaaaa

SEQ ID NO: 124 - DNA, 3827 bp, Rat
gtcctccaggtcccacacggcacaatcgcagggcaaggaactaggatccgagtccaccagacacccaagcctccgaggcacccaggagcccaccctgaagcatgaagccaccagcgaagagatcctctcccctccgtcagactcaggaggccccgatggctccgtcacctcatctgagggctccagtggaaagagcaaaaagaggtcgtcgctcttctccccccgcaggaataagaaagagaagaaaaccaaaggggaagcccggccccccgagaaacccagcccaggcctcccagaagatgtggtagccaagcccaagtccctgtggaaatctgtcttctctgggtacaagaaggacaagaagaaaaagagcgacgagaaatcgtgttccagcacgccgtccagtggcgccacggtggactccggccagcgcagggcgtctccaatggtgagagcagagctgcagctccgccgccagctgagtttctcagaggactcagacctgtccagtgatgacatccttgagaggtcttcccagaagtccaagcgagagcccagaacctacacagaggaggagctgagtgccaagctgacgaggcgtgtgcagaaggcggctcggagacaggctaagcaggaggaactgaagcggctgcaccgagcccagatcatccagcggcaactggagcaagtggaagagaaacagaggcagctggaggagaggggcgttgcagtagagaaggctcttcgaggagaagcaggcatgggcaaaaaggatgaccccaagctgatgcaggagtggttcaagctggtgcaggagaagaacgcaatggtgcgctacgagtcggagctgatgatttttgcccgggagctggagctggaagaccggcagagccgactacagcaggagctgagggagcggatggccgtggaagatcacctgaagaccgagggggagctttcagaggagaagaagatcctgaacgagatgctggaggtggtggagcagagagactcgctggtggccctgctggaggagcagcgactgcgggagaaagaggaggacaaggacctggaggccgccatgctatgcaaaggcttcagcctggactggtcctgagcccgcctgccattgtgtctggtagattggcacccacctgacccggctgcgttctcccaaaccaccggattcaggttcagaagaggcctggcatccctggagaagccgtgctcagacaccatgccgtgggaaaaccccaggtgaggggtatcatctgaggtgacaacacctctgaggagaggcaccttcccccaccccagacttcccactcaggagggaggagatgggtgtgtttgatgtgtgccccagggggaaaacgccttcaggtctatgagggcttgctgcctggcacctctttcaagtggctcctcttcagagccactgccaccacagagcacctgcagagcagagcagccattgccctcatgctccctgaagcaccaccaaagaaagtacagaggcaccttcaggaaagggctgtggatggagatccagcagggacaaccccccacaggggtaatgctcaccctgtcggggcaggggaagtaggcaggttcattatgcaagtcaggagggcgcaggaggggcctgcccccccacacactggatccccagtggccaagtgccccgggcctttcacatggacagtggcctgaagcccgtggattgctgtgttttgcttttagttcacaaccattttgacactggaaagtattgactttgggagagctgaaggaagccctacctgtcaacccctcccccaaccccactacttttgaccgagaggcgcagtccctggtcagcacccacatctgtacaggagatggctctccttggtgttttcctgtgtttgcacattgaaacgagactgacagcctggccagacactcagccacttcggaccctttttttttttttgtcaattaacttatttttttaatacttgaaagtgagcaatgtcatttttttatacctttactaagagacactgcctgtcacctgcgcgtgggagtggcaagaaggtctttgtacatcccatgcaacctgatgcaaaattgccctgattcttgttacacgcatctatttattagccttcttaatagtgttaccgacctgcttggcaccagggagcagcccagggccctgtgggtccttgttcacagctttgccgtcccctcctctacccggcaccctgttcctgttgccactggacttttccaggagaatagcctctctgtatggatgcatttcggagccaggaggccaggcctcgagacaggttgttctggtcttttgggaatcttggctctgtggaccccactttgtccaattttgctgccaaggttttacctcctgtacatatgttaaaggttgaggctagcccctcttcatgcttgctgggaccaagtagagtgtgatgctcagccccagctagacaggaacatgtgtgctggtctcacctcaacataccggccactccaatcttctctgcctatatcaggattttcttggcctggcaggagccagtcagcaccatgtaactagatccataagccaagctgttcatttctcatggttcagccagagaccagcagttggagccagggtgcttctccttcaaaacagcagccacctatggaccagtccattggtaccataccaatctggaaagggcacgccagctgggcctgtgggaggggccagtgcagacaacagccaagggcccacactgaccctggactccccgtgggaaccacactgtgcctcaacttgaacatccatccacccaactccagaggagcaaacagctatcttacttctcaccttgcgcaaaagctgccatctctcctgtggaaacccagatgtgctgctagcaaccgccacagcgctgacgtcatcacttcctggactctgatatggcggcatcgctatttttattccatcagaggaggatgttctggattctattttcaaccacaatctgccaatcaaactggactttggacaggaccttcatcgcctgtgtggccttctccttgaccctgtcctcctctgcagtgccaccggcggcaatcccacgcagctcagccctgtcattcctgctaacccagaacaaggaaaccatttcccgagcgactcaagaaggatgcaggggcacgctgcatctctagctgcctctcagagctctgcaccagatgttcccttccacctctgtcctggtcagccatgacgtgttgatctctccaaagcacacgctgcttccagtgaaagtgggcagaacacttcgcaggagggcctcagaaatccaccagccttgggagacgtcccgcagttctccagtcgtgacgacacgaggacttcagaatcccacagagcacttttttttttaggctaccagtttgtaaccactagtttgcagttgatttcagtggcccgggaacgagacgcgaagtgttctccacctctggaaatgcatacagctctggtcatgcgttcttcccaggaattatgtcttcacttgaaggcagggaagagagggatgtatacacttcatccacacatacagtgctagagtgcttttgagtaaacccaaactcaaggctaaggacagtacatgaggctctaacctctgtccctggagcgcaagcagaaggcagcccgtggctcccaaagaagagcgtggccaacccaggttctgaccctgctcagttgatatctctgcctccaacagccatccttaacgtaattttgaccagcagatgtagacttt

SEQ ID NO: 125 - DNA, 6036 bp, Human
agccgggaaccagaggctccagcaggtcatgcacgcggcggatcctctggagatccaggctgacgtgcactggactcatatccgtgagagagaggaggaagagaggatggcgccggcctctgagtcctctgcttccggagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagcgtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggacgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctagaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggaggagctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgcataaaacaccaggtgcgggagcagcccagactcaaggctgactaaactggaggctgaataccgtggaggtccacatgcagcttccctggagggcaggccggaggcgctcccgcccctgggcttgaggatgctgcaccccgtgggcttccaggcctgcccagatgatgccttcaggcctctgtccctggcggccatcctcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttcaaat

SEQ ID NO: 126 - DNA, 4567 bp, Rat
ggagtttgtccattccttatcattcctttccatatctttaggtatgatctctgtggtttagaaatcccacgttcctctgttgtcagagaaaagttgccttaaacctttgccccgcaagcaccagaagagcgctcataaaaggaagacagcagcagatgcaatcacggatgtggcttagtcttcacagctgccccgagagctgttcagagcgtccgagagcctcagtcatgaatccagaagaacgccttgtgacatggcttatatctttgggagttctagagtctcccaaaaagactgtctgtgatccagaggagttcttgaagtcctcgctgaaaaatggggtagtgttgtgcaaactcataaacagacttctgcctggctcggtggagaagtattgtctggaaccccaaactgaggccgactgcatcgacaacatcaatgacttcctgaaaggatgtgcaactcttcaagtggaagtgtttgagcctgatgacctctattcgggggccaatttctccaaggttctgaatactcttttagctgtcaacaaagcaactgaagatcagctctcagaaagaccatgtggaaggtcctcttctcttagtgctgcgaccagctctcagacaaacccgcaggtggccgttcccagcacagctccagagcagcacagcgaggaaaaggcagagatgacggaaaatggaagtcaccagttgatagtaaaggcaagattcaacttcaagcagacgaatgaagatgaattgtcagtgtgtaaaggggacatcatttatgtcacacgagttgaagaaggaggctggtgggaaggcacattaaatgggagaactggatggttccctagtaattatgtccgagaaattaaacccagtgagagacctctgtcccctaaggctatcaaaggatttgacactgctccacttaccaagaattactacactgtggtgttacagaacatcttggacactgaaaaagaatatgccaaagaacttcagtctcttcttgttacttacctaagacccttgcagtctaataacaacctgagtactgtggagtttacatgtttattgggaaactttgaagaagtatgcacatttcaacagacactctgccaagccttggaagaatgttcaaagtttccagaaaaccaacacaaagtaggaggctgcctactgaacctcatgcctcatttcaaatcgatgtacctggcttactgtgcaaatcatccatcagctgtcaacgtgctcacccagcacagtgatgatctagaacgattcatggaaaatcaaggtgcatccagcccgggtatcctcattctaacaacaagtctcagcaaaccattcatgcgactggaaaagtatgttactctcttgcaagaactggaacgacatatggaggacactcatccagaccatcaggatattctgaaagcaatcatagcattcaaaacactcatggggcagtgtcaagatctgagaaagagaaagcagctggaattgcagatcctttcagaacctattcaggcatgggaaggagatgatattaagactttgggaaatgtgatctttatgtctcaagtagtgatgcagcatggggcctgtgaggagaaagaggaacgatattttctgctgttttcaagtgtcttgataatgttgtctgcaagtcctcggatgagtggctttatgtatcagggaaaaataccaatagcagggatggtagtgaacagattggatgaaattgaaggcagtgactgtatgttcgaaatcacaggtagcacggttgagagaattgtggtccattgcaacaataaccaggacttccaggagtggatggagcagctgaacagactgaccaaaggaccaacctcttgcggttcattgtctaagacctcctcctcatcatgtagtactcattcttcttttagctctaccggacagccccgaggacccttggagcctcctcaaattataaaaccgtggagtttaagttgcctacgacctgcacctccacttagaccatcagcagcactaggttataaagagaggatgtcttatatcttaaaggaatctagtaagagccccaaaacaatgaagaagtttcttcacaaaagaaagacggagaggaaagcatccgaggaagaatacgtgattaggaaaagtactgctgccctggaagaggatgctcagattcttaaggtgatcgaagcttattgcaccagcgccagttttcaacaaggtactcgtaaagattctgttccacaagttctactccccgaggaagagaaactcattattgaagaaaccagaagtaatgggcagaccatcattgaagagaagagccttgttgatactgtctatgccttgaaggatgaggtcaaggaactgaagcaggagaataaaaaaatgaagcaatgtctggaagaagaattgaagtcgaggaaggacctagagaagctggtccggaagctgttgaaacaaacagatgaatgcattcgatctgaatccagcagcaagacctcgattctccagtaaccatcactgtgcagctgagcacagtgccttcagcactccttaaagtggccagctgaatggtttcactgtgcatttgagctttgtgctttgtggtgttgggatgctctctctttcttcctctctcccttcccctcccccttccccctccactgtttgattcagagtttattgcttggttatcagttgattgacacttgttttaacagggggaaatagcctgacgtggtggccaaaatggccccaatactttgctatgcccaacagccctttactacctaattcgctggaggctaagcttctcaggctatgtctagagtaggtgaaaatgaacacctttgcccagtgacccagttgcacttccctttactatcatatggcccccttcagtactttaagaacttattgcccatgttgtctgttgagatcaagaacagtgtagtgcccttatgccctctgccctctgtgctgttgtccatttaaagtcagtgtggtaggaactccaaccatccacaccagcaccaagtctctcagcaaattgcttcaggcagtcctccgtcagcagcagggcaaagcagcttgatggagtacttatccctagtatagcgtagctttacagcccagccctctgcctctatgtaagttttctacctcccctcaaccccatgcttttagccagccatacaaagtggggtgtcaatgatcatggatttgctttgcttatcttgtcagttactgtgagcaatgactttactttgaatattcccatgacaaccttttcacctttctaaacaacttgggtgagaaaatattgtgccctcgtacaccttccatcccatctcaccaagctctggtttctgcaatgagaagttggactcatcagtggcctctaggatgatgatccagattatagaccctgagttaaagggcccctcctagctggagcaggctgtcagtgaagctgactatttgaaactagtttgttcaagttgtttataatgtcaaaccattgactttgtatgtggtccagaaaagtgacccgtgagaaagcagatttcacagagagccccagaagaacactgtatacctaaattcaacacaagtcaaaatgggctgaggatggaggaacacagctctcacctacctcctcagatgacagcacaacttggccagatggcaaagtcactggaaaaagatgcagaaagccaaccaaaggcttacgtgtatattatttgattgggccctgtaagggttgtttcaaaaccaaccttgaggcctaaaagcttgttgaggagcccttttcctttgtgatatggaggctctcacagtttccataactttatggtacagtgctattatctcatgttacatggccaacattatagcacccacaggatgtggagtattcctaaaggccaacctcagacaatcgcatagagctatctttgtcagcttagagagtaaaggttgctaagaacagctgtcctgtttctaagcccagagatttctatgagacatctttcatgtaaaacatttttacaaaaggaataacagtagcaacccacatgttcccatttgtcctgtctgtgcttggtcaatagttggcaatcaatgtgcaaaatttgtccataggaaaaaccacttttgtggtcgccaaataatttagttcattgcttaagacattgaaaggtctcataaaggatgtgtacatatgcatgtttggggactttgcccttatgaggagaggcccttggtactctggataaggaaacttgtgcagtgggctgcccatgcttacacactaaataatataaaggaaatgaagccatgttaactccacagtcatgtctccatagttgtgttgtttacaatactctggaagtaaactgctgcccttaggggcctttcagtttcccctctgttatgtcccttcttataggagctcagattttctaaacttgtttttattttaaagacttttaaaatggacattttcaataaacaagaataaacagtgctttataaat

SEQ ID NO: 127 - DNA, 5283 bp, Rat
ctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcacatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaaccctacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaaaaaaaaaaaaa

SEQ ID NO: 128 - DNA, 1658 bp, Rat
tggagggtctgtgcatggccaagctgagggcagcagacactggacccccggagctctctgcaaccaagtgaacacgtaaggcctgcagagactggcttgccaacagctggacttgatcaccagcttgaaactgagatcatgcaccgggtagaataacaagcggactttgttctctctggctatgcaaagcgttgttttccaaggaattgccacagcagcagacagaaaaccagagatcaccacccggacccctgagtcgttttagagaaccagagttcctgggaagtgtgcaggatggtggtggcccttcaagaagcttctgcttccctggttctcttccttgcagcatttctgcccccaccacaacatgcccaggacccagccatggtacactacatctaccagcgcttccaagtcctcgagcaagggctggaaaaatgtgcccaaacaacaagggcatatattcaagacttccaggaattctcaaaaaacatatccatcatgctggggaggtgtcagacccacacaagtgaatataagagtgcagtggaaaaccttgccctaagagtggagcgtgcccagcaggagatcgactacctgcagtacctgcgagaagctgacttctgcattgaatctgaggagaagacactggctgaaaagttgcttcaagaagaagcagaagaaaagaagatccgaaccctgttgaacacaagctgtgacaacatgctgatggctataaagtctctgaaaatagtgaagaagaccgtggacccagatggctcttggatgaaagatgctggcagtaactctgcaaaagtgtatctattagctggatccagaaacaacacagtttgggaatttgcaaacttgcgggcattcatggaagatagcatcaagcctggtccccgtaagttaatcttaccactttcctggcagggatcagggcaagtggtctaccaaagctttctatttttttcacaatcaaggaacttctaatgagataattaaatataatctgcagaagaagactgtggaagatcgaatgcttctcccaggaggggcaggccgagcacccatctatcaacactctctctctacgtacattgaccttgctgtggatgaacacggactctgggccattcactcaggaccaggtatccaaggccatttggttctcacaaaaattgagcctgacactttgggagtagaacattcatgggatacaccgtgtagaagccaggatgcggaagcttcattcctactgtgtggggtcctctatgttgtctacagttccggtggccagggctctcatcgaatcacctgtgtctatgatccactgggcactgtcagggaggagcatctgcccaatttgttcttccctaggcggccaagaagtcactccatgatccattacaaccccagagataagcagctttatgcctggaatgaaggcaatcagatcatttacaaactccagacaaagaaaaagctgcctctggagtaatggctggcattggagggagagcagtgtgacttgggcagtggttttccgggacactgaggtcacagcccctttatagtggagtatctggccctctcgatgcacataggaataggttctaaaagttgaaatacatattcttcctttcccaaatgtc

SEQ ID NO: 129 - DNA, 2260 bp, Human
ccaggaagcagcttgcaaccactagcctggggagggtccgcatgtgtcaagggtgagggcaacagatgctggacccagggagctctctgccacaggtcagtctacaaggcctcagggaccaacttgccaacagctggacttgatcactagctggcaaactgagctcacgtatcgggtggaataacaagcggactttgctctctgctgtgcaaaacgctgtttttagaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgaatcagaggacaagacactggcagaaatgttgctccaagaagctgaagaagagaaaaagatccggactctgctgaatgcaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttg

SEQ ID NO: 130 - DNA, 2007 bp, Rat
gcttccaccactggtccttaacaaaaatgagatgtgcttgctttgcagggggaatgcaagattacaactacatctgggcccagtgctttgaaattaccctggagctgtcgtgctgtaaatatcctcgcgaggagaagctgccgctcttttggaacgataacaaagcctctttgatcgaatatataaaacaggtgcacctaggggtaaagggtcaagtgttcgatcagagtggagctccattaccgaatgtaatcgtggaagtccaagacagaaagcatatctgcccgtttagaaccaacaagcttggagaatactatctgcttctgctgcccgggtcctacgtgatcaatgttacagtccctggacacgactcctacctcacgaagcttactattccagggaaatcccagcccttcagtgctcttaaaaaggattttcacctcccgctgcgatggcagccggattccatctccgtatccaatccttcgtgcccgatgattccgctgtacaaattcatgccaagccactcggctgccacaaagcctagtctgggcgtgtttttcatgactcttttgtacgtattttttaaataaagcaaggtgtgaaactcgacttccgggaatcagggattggttactcccggttatggcaaccctccctcctgtgggactgcgattgggacagactccactgttttccttaagaagaaaaccggatgtttccaaacctggcctagagcgacctgtaacgaccaaatccatcttcagtctggataaagtggaggtcactgcttagctcatgctgcccacacaaacgccaccccgaaggagtcccaaacacttgtaagaaagttcagaagcaaaacagatatccctacaagaaaaacaatttgtctacggagagccacgtggatcagagccgcaaggacgggcactttctggtcacttgctgtgttacgacctttcgtgttatttgtagagagctgatattgtctataagtggttctccccaaaggaagaaatttctagataacgggactaagagcatttactcttgccaatggtctaaggccaaatgagagaaaatggacaaacatgtctgatgtgggtacagatgcagtggcctctgtctcccgtgcctttgcccttgccccctgcacctgatgccacagtcctacgaagatgacccctcctgtataaccccagtcccttgcctgagcctcagatgcaactccagctgctcaccagacacacccacctgactacgatgcctaggaactgcagttcatccggttgactgttgagacgccatgcaaggctgttcgattcccatatccagtcactggaagctgctgtatacagcctctccaggccagttagcgtccctccgccgctgacccagctgctgctcatgggtattttcgccaagtccgtcttccacacagaacctggggagctgggctgcccaaagctctcctgctccctaaacacaacacagtaagtgctctcggtcccaggtctggattctgattgtgtcacgtcttgtttcctgctcagtaaaactccattccatggggggttaagagcactgactgctcttccagaggtcctgaggtcaattcccagccaccacatggtggctcacagccatctgtaatgggatccgaggctgccttctggtgtgtctgaagacagcaaccatgtagtcatacacgtaaaataaataaattttttaaaaggaagaattccaagcatcgtcttcaacggggaagcccatggagttccaggtggtcaagttcaaggccgatccttcaaagaagttcctttgactagtgactttacagcatcgtggtgtggaactgctctgtgctggccttctctagcacgccatgagctctttaagacaaggatctgcttgagaaataatttctctgagtctagccaaaaaacaggaaataaatggatggggaagtgtctcagctaccgctacagacctttccagaacgct

SEQ ID NO: 131 - DNA, 2075 bp, Human
gggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaaaaaaaaaaaaaaaaaaa

SEQ ID NO: 132 - DNA, 3521 bp, Rat
tgacagaagggaagagcgagattcagaaatcactaggacttcactttcaggaagatccctgtggcaaccaaggaccggcacacacagacccaggagaaactgcagacaaatggagatacaaacggtcccaaggacagcagcgttcacctcctcccactggaccagaaggtaaaagacacagccagcaaaaggaatcggcccaggctgggctccctggggctgctttgcagacagacaaggagacagagagcaggaaggaaccgatctcacctaggaaactgtcctggggaccaaccttcacgtttctctggaaagcctctgcaagcatctccatgaaccactgttggataatacaatgatgtggaaaatgggaccccacttcaccacgctcttggccatgtggctggtgtgtggctcagcatctcattctcctgccttggatagcgacagccacactggacggaaagtacctttggtttctccaatcagcagtaggtcagctcggtatctgaggcacaccgggaggtctggtggagttgagaaatccacccaggaagaaccaaatcctcagcctttccaaaggaggaagagtgtaccagtgttgagattagctcacccgaccatgagaccacccccctcaggtatcaatggagttccagtcagacctgaggtgagacccatagctaggagctcggcgcgtgagatggtccgagatgaggggtcttctgctcggacaagaatgttgcgattcccctctggatctagctctcccaatatcctggccagctttgcaggaaagaacagggtatgggtcatctcagcccctcacgcctcagagggctactaccgcctcatgatgagcctcctgaaggacgacgtgtattgtgagctggcagaaaggcacatccaacagattgtgctcttccaccaggcaggcgaggaagggggcaaggtacggaggatcaccaatgaagggcagatcctggagcagcctctggaccccaatctcatcccaaagctgatgagcttcttgaaactggagaagggcaagtttagcatggtgctgttaaaaaagactctgcaggtggaggagcgctacccttacccggtcaggctggaagccatgtatgaggtcattgatcaaggtcccatccgcaggatcgagaaaatcaggcagaagggttttgtccaaaagtgtaaggcctcgggcatagagggccatgtagtccaggaaggaaacgagggcggtggaggagcaggaggtacaggcctgggcggtgataagaggaaagaggacccaaggagaacacaagtccaccccaccagagaggctccgagaaagcaggccaccagcaaggcagccactcctcagcctcccccaactccaagggccaccacccttcctcctgctccagtcacgacagccactcgggccacatcccgggtagtgacaatagccgcaagacctacaaccaccactgcctatccagctacccagaggccctggacatcccggttgcatcccttctcagtctcccacaggccccctgcaacagcagaggtgaccactgccatgggcccctccgtctcagagcagctataccctctacctcggaaggagcaacagagagagaagccacaggccaccaggaggcccagcaaagccaccaactatggaagcttcacagccaccccacctcccaccctctgggaggtcagcgcaagagttgtgggcacaagccgtttccgggacaaccggacagacaaacgggaacatggccatcaggacccaaatgcggtgccaggtcctcacaagccagtaaaggggaagctgcccaaaaagaaggacagaattctcagcaacgaatatgaagacaagtatgacctcagccagcccacctcctctcagggggaggaggagcggcaggtggatagcgttccctcgcagaatgccaaggagtcgaaaaagcttgaaaagctcgagaaacctgagaaggagaagaagaaaaaagggaagagtgcaaaacaagacaagttactcaagagtgaaaagcaagcgaagaaagctgagaaaaagaccaaacaggagaaagacaagaataagaagaaaaaggcgggtaagacagagcaggatgacaatcagaagcccaccgcaaaacatctcgctccaagtcccaagaagtcagtggccgacctgttggggtctttcgaaggcaaacgaagactcctcctgatcaccactcccaaggctgagaacaatatgtatgtgcagcagcgggatgaatatctggagagcttctgcaagatggccaccaggaggatctctgtggtcaccatctttggtcctgtcaacaacagctccatgaaaattgatcacttccagctagataatgagaaacccatgcgtgtggtggatgatgatgacttggtggaccaacatctcatcagcgagctgaggaaggagtatggaatgacctacgatgacttcttcatggtgctgacagacgtggatctgagagtcaagcaatactacgaagtgccaatagcaatgaagtccgtgtttgatcttattgacactttccaatcccgaatcaaagatatggagaagcagaagaaggagggcattgcctgcaaggaggacaagaggcagtccctggagaacttcctatccaggttccgatggaggaggaggttgctggtgatctctgctcctaatgatgaagactgggcctattcacaacagctctctgccctcaacggtcaggcatgcaattttggtctgcgacatataaccattctgaagcttttgggtgttggagaggaagttggaggagttttagaactgttcccaattaatgggagctccatcgttgagcgggaagatgtgccagcccacttggtcaaagatatccgcaactattttaagtgagcccagagtacttctccatgcttctagttggaaaagatggcaatgttaaatcttggtatccttctcctatgtggtcgatggtcatcgtgtatgacttaattgattccatgcaacttcggagacaggaaatggccattcagcagtctctggggatgcgctgcccagaagatgagtatgcaggatatggttaccatagttatcaccaaggataccaggatggctaccaggatgactaccgtcatcatgaaagttaccaccatggatacccttactgaacagaaatatgtaaccttattcccatccagtttccccttcatctgctaaagctgtgtgctggcagcttcataagggaatttctccatactctacataccccgactttttctttcagtgttcttccaagattaaagaaatagtaaactttcccctactcatgacttgttattaagacatttaaaagaactctctaactggagagagaaaagtgtggtgctaaataatttttactgaaaaacaaaaggtagtatctcttttcttatctaatggctattatttgatatgcaaatgtatataaaatgtttatacatcttcc

SEQ ID NO: 133 - DNA, 439 bp, Human
  misc_feature (89)..(125): n=a,c,t or g
  misc_feature (148)..(148): n=a,c,t or g
  misc_feature (190)..(190): n=a,c,t or g
  misc_feature (270)..(270): n=a,c,t or g
  misc_feature (309)..(309): n=a,c,t or g
  misc_feature (318)..(318): n=a,c,t or g
  misc_feature (383)..(385): n=a,c,t or g
  misc_feature (387)..(388): n=a,c,t or g
  misc_feature (390)..(393): n=a,c,t or g
aatcttggtatccttctcctatgtggtcgatggtcatcgtgtatgacttaattgattccatgcaacttcggagacaggaaatggccatnnnnnnnnnnnnnnnnnnnnnnnnnnnnnnnnnnnnntatgcaggatatggttaccatanttatcaccaaggataccaggatggctaccaggatgactaccntcatcatgaaagttaccaccatggatacccttactgaacagaaatatgtaaccttattcccatccagtttccccttcatntgctaaagctgtgtgctggcagcttcataagggaatttntccatactntacataccccgactttttctttcagtgttcttccaagattaaagaaatagtaaactttcccctannnannannnnttattaagacatttaaaagaactctctaactggagagagaaaagtg

SEQ ID NO: 134 - DNA, 1639 bp, Rat
gaatcgacctcacagagggtgctgcagagggccatggggttatataaatcccagggcagagggaaggtggagaggagggagtcaagagaagcagaggatggcaggagagccagagttccatcagtcaaagaatcatgaggaggaggtcacatctggagagcagggatttgctgagcatgaccccgagggtctcatttgcagctccaagagtttacaagggcatctgacccaagtcccctggcttctgctgcttctcatctctttgggcctctttttgcttatgttggccaccctggttcaagtctccaggattcgtgcatactcacagggacagacccaggatcagcagggtagctccagcttggacaaggttgccgttcctcgggagcagacacactccggcttggagcagatccagcagattcagcagcagctgactcagttcaacgcctcgctggctggcctgtgccggccctgtccctgggactgggagctcttccagggaagctgctacctcttctccagaaccctgggcagctgggaaacctctgcctcctcctgcgaggatctcggggcccacctggtgattgtcaacagtgtttcagagcagagtgcctctagacttgagtgcagagtgaagttgtgcgcgaggctgagaagagtgggaagcagagaatcgcagacctttctctgtgcagagattcatgaaatattggaatgtgaggaaaaaccaacgctcctggatcggcctcagtgaccatatacatgaaggttcctggcagtgggtggacggcagcgccctcaagttcaggtgaacactgagattccatggctcagaaagcagctggcaggggaatcattctaaatacaaccttcactgctgagaagaactcagagagcattataactacaaccctacattacctgggtattttcacatcctgcccccagcttaagtccaaagtccagagacctttgaaagagaccttttcctttgctgtgctgattctcttaggggtcatgttagaactcacttatattttaatagctctgccacgaacccctgcccactgcttggagggttcttggtcttttaccataaaagagtgtatagcttttctttgctagctactggtgggttctgggtggaatggctctgtctgacagccagtgatgtttgcagcttttggaaagagggggaacctaacaatgacggagatgaggactgcgtggagctgttcatggatgattggaatgataataagtgcactgaacagaacttttgggtctgtgagcagccctctgctccctgccctcatcactgaagatctgtgctcccctagtcacacaggcaacttgggggcactttgctcccattccagctgccttattcatcccagtgcccctgttctgagacctttgagatcctgagagagttcctgaggcaccctaccctgcagtgcttccctcttcctctgtaggtgatttcagttccacaaatcctgagctcaggagtcccctcagtagaatcatacatataaggagttggggtgtagctcgatatactagagtttgcctagcatgggtgactctctgattccattctcagcacccaaataaaaaataaaatattaaattc

SEQ ID NO: 135 - DNA, 427 bp, Rat
tttttttttttttttttgccaacacagacaggaagtaactttaattaaatatcgtgaacgttgaaaagttttttacagtttgaatttttgaaaaaaaaaaaggagaagaaaagaaaagaaagaaagaaataaaaaagaatgaaatataacaatctctacagtagttgagtgctctaacaattggattgtacagtgtgtgtctattgaaaacgtttgaaaagaaggtgaaagatttgcagaatgagttcatggagctgcatcctacattgtgaggccgggcatggcgtggacatatccagtcatccagaggcagggctcttcccccaaaacggaaatctgaattgaattctctactccatcttctttttaaaagccatattctgtatttagggggctatatcttaaagggacttaaaaacaagatttt

SEQ ID NO: 136 - DNA, 588 bp, Rat
agaacaccaaagctaattctgcctgtggctggcaacatgaaggacgaagtggctcttctggctaccgtcaccctcgtgggagttctgttgcaagcctacttctccctacaggtgatctctgcacgaagggctttccacgtgtcgccgccgctcacctctggccctcccgagttcgagcgcgtcttccgagcccaggtaaactgcagcgagtactttccgctgttcctcgccacactctgggtcgccggcatcttcttccacgaaggagccgcagccctgtgcggactgttctacctgttcgcgcgcctccgctatttccagggatacgcgcgctcagcgcaactcaggctgactcccctatacgcgagcgcgcgcgcactctggctgctggtggcgatggctgcactgggcttgctagtccacttcctccccggcacgctacggactgcgctcttcagatggctccagatgctcctgccgatggcctgaggcgaaggccctccgaatcagcagaactggagatcttcgaacaaaacgctggggtgcccgcccccgaatcccagtttttaattaaagttcccacgacgg

SEQ ID NO: 137 - DNA, 680 bp, Rat
tcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagaaaaaaaaaaaaaa

SEQ ID NO: 138 - DNA, 4395 bp, Rat
gagaaacttgctggtcttctccgggtagcatcgcaccgtaccgcggtcagctccggacagcccggcctggggacaatgaggtcgtcatgcgtcctactggccgctctgctggctctggctgcctactacgtgtacatcccactgcccagcgcggtgtccgacccctggaaactgatgctgctggacgccactttccgcggcgcgcagcaagtgagtaacctgatacattccctgggactgaaccaccatctgatcgcgctgaatttcatcatcacctcttttggcaagcaaagcgcaaggtcttctccgaaagtgaaggtgacagacaccgacttcgatggggtagaagtccgagtatttgaaggttctccgaaaccagaagagccgctgcgacgcagcgtcatctatatccacggaggaggctgggccctggctagtgcaaagatcagctactatgaccagctgtgcacaacaatggctgaggagctgaacgccgtcatcgtttctattgaatacaggctagtcccacaggtctattttccggagcaaatccatgatgtcatccgtgccactaaatatttcctgcagccagaagtcttagacaagtacaaggtcgaccctggaagagtcggtatttctggagacagtgctggtgggaatctggccgcggccctgggacaacagtttacctacgttgccagcctgaagaataagctcaaactgcaggctttggtctacccagtcctgcaggctttggacttcaacacaccctcttaccagcaaagcatgaacactccgatcctgccgcgtcatgtcatggttaggtactggttagactacttcaagggcaactacgactttgtagaggccatgattgtgaacaatcacacttcacttgatgtagaaagggctgcagccctcagggcccgtctcgactggacatccctgttgccctcgtccatcaaaaagaactacaagcctatcatgcagaccacagggaacgccaggatcgtccaggagatccctcaactgctggacgctgctgcttctccgctcatcgcagagcaggaagtgctagaggccctcccgaagacctacatccttacctgcgagcacgacgtcctgcgggacgatgggatcatgtacgccaagcgcttggagagtgcgggtgtgaacgtgaccttggaccactttgaggacggcttccatggttgtatgatttttacaagctggccgaccaacttctccgtgggaatccggactaggaatagttacatcaaatggctggatcaaaacctgtgacggaggaaactcctcagacgcatgaagctcttgacctccgtttgctttggaaaaaacaaaacaaaacaaaacaaaacaaaaaacaaaaacactgcgcatttcaatcatctgcacctttccctcgttttgcattagtactgaaatctgtaccctacagaccttataataatttgcaaagtgactctgactaacgcggttaagaacatctgaacttggtttcccaaatgactcagtttttgctttcttttctgaagcccgagtgctaggtaggaatggccacagtttgaagagctagaaatagccttaggtcgggcttctgttatgtgctttccagaagcagtttttacaactgtaggtaaggttgtaaattctgaggaacaacaacaccaccaccacaaccatgagcctttcttcagtttgctcgggttgacgcgggctgcagagcagcgtctagtggacattccgaggccagctcttgggactgtgtagcctctgcctcccaggatgttgtctttcatgtgggaattttgacaggatttctagcaagacagatttcttctcgaaagcttttcttcctcaggagtatgaattttctgagctagctgctgtaaattcagtgaggctaaagggatacttgaatgttattttttttctcctaagaaaatgggaggctacatgcactggatatgtccttgggaaaatctttggggaacaaacttatttaactgtagagtaagtttcctattatgaaataagtaaaggtagaaaaataatggtctgttgttacttaagaatactcctggcataagttactagaagtggtgtgtatatattcgggggagtaaggaaataagttatgtttaataatagcttaagatgaccagcaatgcctgtagaaggctttgtccgtttttggcagaaggcctagggcatcgaaaactcagccttttcactcgtagctgaaaatgggactattttggtatagcagttgtttttttttaagttatttaatgttaatatatatatatagctaaacagggtttttctgaaaaacattataaaaaatttaagataaaaggtattttaaaaagaaaactaccataaagttatatccacatgtaatttttttgaggagatcgataagagtagtaggcaccacatgtaagtcagggtcaaatacttggatatttatctgcatatgcaaattaaaataattagaaactttctacctagtacgtcatgttgtactaggtacatgatgctggtcagccatccttaatccaaaattttgagtcaagtcttataagtggaaaattccagtgaacatttattttgtatataaaattttaaacctattgtgtgaagctaccctcaggctatgtagatcagatgtataaaaagcacaaatgaatatctcaattacatttgggttccattctcaagatattttattatgtatattcaattcaaatattctaatgtctagaaaaatgaaaaccctggatattctggtcctgagttgttcagatgagggagagccaacctatagtttaacagcttaggtaagactcactctgcccatgctggccaggggaaccctcaggggactcctctgggtgaagggcagatgctagcactgcctgttcttagttctccttccattcctgtcctgaagttctaactgccgagccttaccttcatagaaggtcttcactgccagagtgggcatcttgcatagtaagggattccagattagatatgagttgagcaccctgcctttcttcctatcaccccgcttctgctgatagtccgtgctacattaagggactgagcagagaacactcagtcaagtcctgatccatttcgtcatgaagagagcaggacctttccattctatgaagggtgcgtgtttctggtttccagcagcaggataacaagtgggaatttactcactgacttctcatttatcataaaagctgcagcacctttatgtacagaacaatgtcacagtgtgtgtgtgtgtgtgtgtgtgagcgagcatgtgctgtctgcatatggaaataactacagcacaggctaccttgctgatgtgtccatgtcactggtctcccttttagctaaaatctgagagtagaataacctgatctttgaggcctcttccaatgttagtcttttctaaggtaatttttagtaggtcataattcagtatatactagcctactcatctctgaagactgactttgctcgtaatttttttttaattggccacatagcattaatgcctccacagggttcctgtgtttcacatttacgatataaattgatacccatcttcagctgaggttgttatggggggctggaatcacgtgttttttaaacctgatattttcattcctaattgagtgacagccatcttttaaggtgttgggcatggaaccccaggccttacctgcttggcaagtgctttacccccgaactacacctgaagctccattccttgtcccttctgcaccatttaaaggtgggaactatattttgactttatctacctctgagaaagaggaaaatgtaattattcacagagtttctcaaaatggcatctttcctcccaaactgggagccaaattctgcagaaatcatggacagtaaatggtgacagatgtctgaaggggtctcaaagatgcaagggaacatggggtcaaaggggccacccaccacatctgatgatatgttagttttgttgttctttggggttttattcttccaggtatgttatgcactacagcctgatcttttcagtctaagacagcatggcttcactttcctgtgttatgagaaggtcacactttggaatactgaaggacaatcctgaagtgctgcagcgcatagtgaatgcctcttggtgttttcacgttcgtctgtgaggactcatagacttacagaatgatgccgaatggaatgttttgtgcatgaccttttaacctttggctattgccaattccccactgcaaaggggaaggcagattttatgaagagttttaggaataaatacattttatagaatggaaacccagtatggtactggggaagttt

SEQ ID NO: 139 - DNA, 4150 bp, Human
gggggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgccaaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattatgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtatactggcacctggtgttgcctagatcccccatctcctccttccagccaggtctggaagtttcaacagcccaagcttaacttcatgtaaagtcttcactgccagtggtaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttcccaagaattgtgagccaaagcctatagtaattgcagacagcaaatgattccggatctctaaaaggctctctcagatgaaaagggagtaaaggaagaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgcaaaaaaaaaaaaaaa

SEQ ID NO: 140 - DNA, 216 bp, Rat
tttttttttttttttttccaaagtcactgctgcagtttaatcaaataagagcaaaaggtgacatttccaagtaccaaaacttgggtaggaacactggggctgggtggtgggaggggagagggtgcctacaatgcatgccttgctgctgcactgactggattataggtcagcaaagcctgttggagggaagggaggaggcagcctcatagctataga

SEQ ID NO: 141 - DNA, 2780 bp, Rat
cggagaccgttctgtgctccctccgcccgcaaccatggcaaagcccctgaccgaccaggagaagcgacggcagatcagcatccgaggcatcgtgggcgtagagaatgtggccgagctgaaaaagggtttcaaccgtcacctgcacttcactctggtcaaggaccgcaatgtggccaccccccgcgactactacttcgcccttgcgcacacagtgcgcgaccacctggtggggcgctggatccgtacacagcagcactactacgacaagtgtcccaagagggtgtattacctctctctggaattttacatgggccgaacattacagaacaccatgatcaaccttggcttacaaaatgcctgcgatgaggccatttaccagcttggattggacatggaagagttagaagaaattgaagaagatgccggccttggcaatggcggtcttgggaggcttgctgcctgcttcctggactccatggcaaccctgggacttgcagcctatggctacggcattcgttatgaatacggaatcttcaatcagaagatccgagagggatggcaggtagaagaggcagatgactggctcaggcatggaaacccttgggagaaggctcgccctgaattcatgctgcccgtgcatttctacggaagagtagagcacacccagacggggacaaagtgggtcgacacccaggtggtcctggctctgccttacgacacccccgtgcctggatatatgaacaacactgtgaacactatgcgcctctggtcggctcgagcaccaaatgactttaaccttcaagattttaatgttggagactacattcaggctgtgctggaccggaacctggctgagaatatctccagagtgctctaccccaatgataacttctttgaagggaaggagctgcggctgaaacaggagtactttgtggtggctgccaccctgcaggatgtcatccggcgcttcaaggcctccaagttcggctccaaggatggcgtgggaaccgtgtttgatgcctttccagatcaggtagccatccagctgaatgacacacatcctgcactcgccattccagagctgatgaggatttttgtggacattgaaaaactgccctgggccaaggcatgggagatcacgaagaagaccttcgcctacaccaaccacacggtgctcccggaggccctggagcgctggccggtggaactggtggagaagctgctgcctcgacacttggagatcatttatgagatcaatcagaaacatttagacagaattgtggccttgtttcctaaagacatcagccgcatgcggagaatgtctctcattgaggaggaaggaggcaaacggatcaacatggcccacctctgcatcgtgggctgccacgcggtgaacggtgtagcaaagatccactcggacatcgtgaagacccaagtattcaaggacttcagcgagctagaaccagacaagttccagaataaaaccaacgggattaccccgaggcgctggctcctactctgcaacccagggctggctgacttgatagcagagaaaattggagaggattatgtgaaagacctgagccagctgacgaagctccacagttttgtgagtgatgacatcttcctccgggaaatagccaaagtgaaacaggaaaataagctgaaattctcccagttcctggagaaggaatacaaggtgaagatcaacccatcctccatgtttgatgtccacgtgaagcggatccacgagtataaaaggcagcttctgaactgcctgcatgtgatcaccatgtacaatcgcatcaagaaagaccctaagaaattcttcgtgccaaggacagtcataattggtggcaaagctgccccaggatatcacatggccaaaatgatcataaagctgatcacctctgtggcagaagtggtgaacaatgaccccatggtcggcagcaagttgaaagtcatcttcttggagaactacagagtgtctcttgccgaaaaagtcattccagccacagacctatcggagcagatctccacggcaggcacggaagcctctgggacaggcaacatgaagttcatgctgaacggggccctgaccatcgggactatggatggggccaatgtggagatggcagaggaagctggggaggagaacctgttcatctttggcatgagagtagatgatgtggctgctttggataagaaggggtatgaggccaaagaatattacgaggcccttccagaactgaagttggtcatcgaccaaatcgacaatggcttcttttctcccaatcagccagacctcttcaaagacatcatcaacatgttattttatcatgacagatttaaagtctttgcagactacgaagcctatgtcaagtgtcaagaaaaagtcagtcagctgtatatgaatcaaaaagcctggaacacaatggtactcaaaaacatagctgcctcagggaagttctccagtgaccgaacaattaaggagtatgccaaggacatctggaacatggagccttcggatctgaagatttccctatccaacgagtccagcaatggggttagtgccaatgggaagtgaatgctaaaatgtactcttattcaatgacttcttatggaacttgagtattttagagcttccctgattctgtttttgtcattgaatagttaagtgtctccggggatgggaagggaaaatgtatgtctgtattagagctaaaaataaaatgtcaacttccagttgtcaatcaataaaaaaaaaaaaaaaaaaaaaa

SEQ ID NO: 142 - DNA, 2643 bp, Rat
ccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgatactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctacaatgtctctagaaaacatagcttcttactgaacttgaacat

SEQ ID NO: 143 - DNA, 1466 bp, Rat
cgctcctcaagcttctcaactctggactaagaatcttggaacaagagcaaaccccactgctgttgaggagacctcacctttctgcctccagctctccaaagggacttgcatccatctagaagagaggagggtgtattcaccaccctgtctttgttggcctttaatctaactttacctgacaccttgggccaactttgatcacatctcaccctctacttttgttttgtttttggcaagagtggacattggccctctggagcctgttttgggcagagggtgttgagagagtactgaggactgagcggccaggactgtgtgctgaagtcaccatgtccaccaaggtccccatctatttgaaacgtggcagccgcaaaggcaagaaagagaagcttcgggacctgctgtcctcagacatgatcagcccaccacttggggacttccgtcacactattcacattggcagcggtggcggagatgacatgtttggggacatctccttcctgcagggcaagttccatctccttccaggaacagcggtggaagaggctgaggaggatggcagctttgaccttcccttccagtttactcgcactacaaccgtgtgtgggcgagagctccctgatgggctgtcacctctgctcaaaaacgccatctccctccctgtaattggtggcccccaggccctcactctgcctacagcccaggctccacctaagcctcctcgcttgcaccttgaatctccacagccttctccacagccttccccacagggggcaggaaatgtggacgtctggaggattccagaggctggctcgccccacaatgggatgagccctgagccggaggccgaggagcccttcctgtcccatgccagctccctgctgtccctgcatgtggacctggggccttcgatcctggatgatgtcctccagattatggatcacgacctaggccgcgtgcagattcctacataaaaccctcggctggccaggcaggtcgcccaggctgtgctgatgcctggagacatctatgggcattggccctgacctaggagtcaggatcccaggtcacacctatgggtgctggctagtgactgccattttgagcctttgttttcccttctcctaatggacagagtgtatctttgttttcatctaacaacatccacagaggagccatgcagaagttgccttagagactcctgaatctctttggtcatttgccctcactgccaattgccccctttccctcgggtccctgtggggaagactctgctaaaatggagcccctcctttgttggtatcgttggctatgctccccactggtctttgtgtttgggtctgggagtccagaaatcgtgacatctcccgccttgtgtcctgtcccaacccttcctcacatgaccagggaattctggtcgcaataaaacatgttgctgctggtgaaaaaaaaaaaaaaaaaaaaaa

SEQ ID NO: 144 - DNA, 1976 bp, Rat
cactctgtaagttcaccgccggtcgggtccggccgcagcgctgtccagctcctgagaccttgctgtccgccggtctgccgtctgcgcgcctcacgctcctcagccctggaccggggacaagtaaccctcggtgacaagaccaaagtgcactgctgctcacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtcccaagatcccacctgtatggtcgctggccagtgattctccttctgagccgtgtttcccctctccctccctctccacgtgggcagggcaggccccatcgctttcctctgataaccacatggacacatcctgaagtcagcccaggcgccctgagcatcttggggcacctggaccccatcacaatactccttcttccttcaggtccctgggtgaaggctttgctgaaaccgaccccccttttcacgtcccttctgcctctgccccgttggatgccctgactgggggcaggggaagagacagggcacagctggccacagggctcagccactgagcaggctgttccgggcctttggctttgcatcctggacggggagtgtcctgtcagggaccagatgtgtcctgcctcatccctagctccaatcccttccccacgtgaccggggattctggttgcaataaaacatgctgctgctggtggcggagctccctgtccctttgccccaggtttcctcccggaggcagacagtctcccagagctgagggcttgcctctggagaccccagccccagagggctttgtggaggacaggccttgccctcaagaatgtcgtacctgacgctgagcctgtcatgagaatgcaacaggagcaaaccaagtgttgctgtgacattgattcagatgtttggcaagaggtggctgagcactggggtgggcttggcactgtgccaagcctggggccaatccctgcccagtcagctggggtctggtgggggacacccaagaataaaagaataaccacaaagtgtgca

SEQ ID NO: 145 - DNA, 324 bp, Rat
tttttttttttttttttaaaaaaggggggaaaaaaaaatttattcccaaaaaaaggcaaaaaaccaaagggggggggtacggtggggagctcctcccccttccccttcctccccggtctctgaaggccagggaaaaaaaatttgagggaaacatgcaatcaaaaaaaaggttaaactctaaagaaaaagggttgggcccaaaaaaacccaaaaaaattaacccaattacgtgaacagcttcacggagtaggattaaaatattgtaaacgtagggtttccaaaggggggcccttcaatgcacaaggggggcttgtttcagggaaa

SEQ ID NO: 146 - DNA, 1385 bp, Rat
gaggaagtaggtagctgtagaatgccaacaaacattttgaatcaaactggacataccactaatgcaaaatgaaaaggccaagagaggttaaaaccaacagaagttgtggctcaccctttataatggagccagggcaggaaagcaaaaggcagaattcagggtttccaaagtgggaggtggtaacgtatctccaggttaagcaaggaatgttaggcagattttcaaagactaagcagagttctcttcataagagaagcaagtcagtaagtaacccagcctttatttagtgaagaaacaacttcactaatttagaaaacagaagaatattaaagacaaaaaaaaagagagagagagagaaagtagtaggactatcacatagtttattataaaatcagaaaatttgagttgggtttagtggcaaaatgatcagaagttcacagccaacctgggatacagaggaagaccctgtcttagaaaaaaaaaaaaaaaaaaaaaaaaaaagaatgaaagaaaagaaaaaggttaaaaaaaaaaaaaaggaaaaaatcaaaagaaagaaaaaagaaaacaacaaaaaaagaaaaagacaaaaaaaaaaaggaactatgagaattgaaagaaaagttggacacaggttgaattataattaatatggcctacaacaaaaattcacatagctccaatggtaaaggaggctatttggctccctaaaagtttcatcaagtatcaatgaacgggttgggtaaggggagtaaatggttacaaagagatgagtttgtaagtggcacaatcttcagaaaccagtatcttagagccaaggatgtttatagattgagcaaagaaagttataatcaatgaataatagtctgaagaatactggagggcacatatcttttgaactatagaagaactaattttaaatatgctagtagaaaaaaattaaggaagcccaaaattaaacaaaatattgtgtgttattatgtttggtaccaggcgatacttaaacaaataaaataatttgtccaattcacagatttagtatgtggtagggccagaattaaaattattacctttatctattaaacccatattcctttgtaatatgctttattattttcaagttgaaagaaatcataaataagaatttctatattttccttgagactgtaaggaaaaatattttttctgagataagatatgttttagaagtgacacgattctgaagtgactggtaattgttagaatatctgcaatggggaaaagttcaatgttaaagaaaagacagacaggaggatgggctccattaccacctctgtcctggtatttcatatcgttcattgcacagtagagctgagattggctacaggctaaaattcatgaattct

SEQ ID NO: 147 - DNA, 273 bp, Rat
atgttgggaacactgtttggctctgccataggaggagctctggctgtggcaggggcacctgtggccctggctgccatgggcttcactgggacaggcattgcagctgcctccatagcagccaagatgatgtctgctgcagcaattgccaatggaggtggagttgcagcaggaagcctggtagccacactccaatcagcaggggtccttggactctccacatcaacaaatgccatcctaggggctgctggggcagctgttggagccttgctctga

SEQ ID NO: 148 - DNA, 384 bp, Rat
cggccgctcctgtttcccttgtagagcgctatacataaggaaagcaatataagaaaatgtgtggttagctgtactactgagaggcatgcaacacagtgcgagcaagcatgcttgggaagagctggcagaagctccttgcatttaatgaacactcatatttgtttctggcaactgggttcactggcacaacataaaggaaaaaaatggtactacacagaaccattattggtgaaacaagaatgttctagaatgaagtctttaaggaatctacattggttgagtaggttcccaaatcccttaggaagttctcagctaccaaatgcctacttcaaaaatatacctctctttattcttcttctcttcattaacataatgaaacagttc

SEQ ID NO: 149 - DNA, 2195 bp, Rat
gtcccccgctcagagctgcggcttctcgggtcgagcccccgatggaggccgaagccgcagatgcccctccgggccgagtggaggcggcgctcagctgcttctctttcaaccaagactgcacatccctagcgattggaaccaaggccggttacaagctgttttctctgagttctgtggagcagcttgaccaagtccatggaagcaatgaaatccctgacgtgtatatcgtggagcgcctcttctccagcagcctggttgtagtggtcagtcacacaaaacctcggcagatgaacgtctaccatttcaagaaaggcactgagatctgtaattacagctactccagcaacattttgtctattcggctcaaccgacagaggctgctggtctgcctggaagaatccatctatatccacaacattaaggatatgaagttattgaagaccgtcctggatattccctcaaacccaacaggtctctgtgccctgtctatcaaccattccaactcttacctggcctatcctggaagccagagtacaggcgagattgtactctatgatggaaactccctgaaaacggtgtgcaccattgctgcccacgaggggacgctggccgctatcaccttcaactcctcgggctccaagctagcaagcgcgtctgaaaaaggcactgtcatccgagtgttctctgttcccgagggccagaaactctatgagtttcgtcgaggaatgaaaaggtatgtgacaatcagctccctggtgttcagtatggactcccagttcctgtgtgcctccagcaacacggagaccgtgcacatcttcaagatggaacacctgacagacagccgcccagaagagccttccacctggagcggctacatgggaaagatgttcatggcagctaccaactacctccccgcccaggtgtcggacatgatgaaccaggacagggctttcgccacaggacgcctgaacttctctgggcagaagaacatttgcaccctgtccacgatccagaaactgccgcggttgctggtggcctcctccgacggacacctttacatctacaacttggacccacaggatggaggagaatgtgtcctaatcaaaacccacagcttgcttagctcaggaacaacagaagagaacaaagaaaatgacctcagaccttccttacctccatcttatgctgcaactgtagcaaggcccagcacgtctgcagcctccacggtgccaggatactctgaggacggcggggcgctccgaggggaagttattccggaacacgagtttgcgacgggaccagtgtgtctagacgacgagaatgagtttccccctgtgagcattcggaacccttaacagagttactccatctgtatgcctggaaggaagccttgcctcccagaagaggccaagtgtctgccccgcgctctaactcctaactgctaatctgctttacaaccagagcccccccacccccccggggcacccactttgtggtttcagatcctgcaggctagcctatcggtgtggtgcttcaggcctgtcagcgttgccgtaaccaaatactaacctggggagtgtggatggctcagagacctagactccttgcctctgtctctatacatacactaccttagttccctgtgaggtcagagtttctgcctgtgtctggtttcccaaagcgcctaagattgcttttgtagaatgctgcctgttacttgttaggatgagttactggggctgggtcttgtctgggactctgggctggctgcaggaactgacttgcaacccacctgcagctctggtaccgaactcttgagcctccccagcagctgcagctgcccaccaggaaaccgcatggataaagccagggtgggtggcaggagctggagactgtcagggcctccttagctcccatccacatctacagtgtagcagtgtatgcgcctcctgtgtatctccgtcaggaaacatcccagtggcaagggatgtggcccagttggtagaatgcttgcctagctagcgcatacgaagccctagcttcggttcccagcagcacttacaattgagcatagtggttcacacctggaattccagtacttggaagcaagggtcatctgaactacatagtgagttcaaggccagcctgaattatatatataaggccttgtctcaaaaaaaaaaaaaaaaaaaaaa

SEQ ID NO: 150 - DNA, 1907 bp, Human
ccgcggacgcgtggggctgaggtggctgtcgccggctccgagctgcggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgcaaaaaaaaaaaaaaaa

SEQ ID NO: 151 - DNA, 493 bp, Rat
  misc_feature (482)..(482): n=a,c,t or g
aattcgtcgacatgctattctccaagggaagagactaaattacacccagctgagaaccagttacctaactcaatctgtaggtttgtgttgcgcacattttattgtaaatccggagtccggttcttatgagcaaatgcaagaacacttgaggattcgtaattggtactgcaaactcttctccccacatttcccctctcccccactgcttcagcactcatccaaatccacagatagccacttccaggagccctgagcctctctggcatcaaagtgcagtgagtctgagcacaaagcaaggtgcaagtttatccctcagaagtagacatgagagacagtaacaagccagcttcctagctcttcgataagcccgaggtgtgttctactcctttcaggagtatccagtgagaccacagtgggaactggcttcccagtctcaccttctgctccccaacttattccctaggcttgcttcccaaatgctntcacaacatcc

SEQ ID NO: 152 - DNA, 1288 bp, Rat
cttctacctggggctatgatccgtgggcgggcgcctaggactcggccatcaccgccgcctccgctgctgccgttgctgtcgctgtctctgttgctgctgtccccaactgtacgcggagactgcggcccacctccagacattcctaatgccaggccaatcttgggcagacactccaagtttgctgagcaaagcaaagtggcatactcgtgtaataacggctttaaacaagttccagacaagtcaaacatagttgtctgtcttgaaaatggccaatggtcgagccacgaaacattctgtgagaaatcatgtgttgctccagaaagactgagttttgcatccctcaaaaaagagtacctcaacatgaattttttcccagttggtactattgtggaatatgagtgtcggccaggatttcgagaacaacctccactcccaggaaaagcaacttgccttgaggatttagtatggtctccagttgctcagttttgtaaaaaaaaatcatgccctaatcctaaagatctggataatggtcacatcaacataccaaccggcatattattcggttcagaaataaacttctcatgcaacccagggtacaggctagtcggtgtctcctctactttctgttctgtcacaggaaatactgttgattgggacgatgagtttccagtgtgcacagaaatacattgtccagagccaccaaaaatcaacaatggaataatgcgaggggaaagtgactcttatacgtatagccaggtggtcacctattcatgtgacaaaggcttcatcctggttggaaatgctagcatttattgtactgtgagcaagtctgatgtaggacaatggagcagtccaccaccccggtgcatagagaaatccaaggtcccaacgaagaaaccaacaattaatgttccaagtacaggaaccccctcaacgcctcagaagcccacaacagaaagtgttccaaatccaggagaccaaccaactcctcagaaaccttccacagttaaagtttcagcaacccagcatgtacctgttaccaagacaacagtacgtcatccaataagaacatctacagacaaaggagagcctaacacaggtggtgaccgttatatatatggacatacatgtttaataaccttgacagttttgcatgtgatgctatcactcattggctacttgacatagccaacgaagagttacgaagaaagtatataaaactactgataatacttctagtttgttagactgtccaagaagaatggatacaataaatttaatagtgtcg

SEQ ID NO: 153 - DNA, 208 bp, Rat
  misc_feature (148)..(162): n=a,c,t or g
gagaccacgtttagtaatttacctgtaaacacagatctgagtcaggaatagttcactgtgtttaagaaggatacactgcagtttgctctcagggaaatcttgttttgttttcaccagtaaaaaatgccctaggaaggtatctttcacnnnnnnnnnnnnnnnataatagtgtctgatggtatcgtaacatctacatatgaacaggttt

SEQ ID NO: 154 - DNA, 2178 bp, Rat
aggcttgtcctctaggtctcccaagaccacagacatgaggctgctcatcccttccttgatatttcttgaggcccttggactctgtctagctaaggcaacaactgttcaatggtgtgctgtgtcaaattctgaggaagaaaaatgtttaaggtggcagaacgagatgagaaaagtgggtggcccgccgctcagttgtgtcaagaaatcctccacccgccagtgcatccaggccattgtgacaaacagagctgatgccatgactcttgatggtggcactttgttcgatgcaggaaagcccccctacaaactgcgacctgtggcagctgaagtctacgggaccaaagagcagccccggactcactactatgcggtagcagtcgtgaagaacagcagtaactttcatctgaaccaactccaaggcctgaggtcctgccacaccggcattggcaggagtgcggggtggaaaatccctatagggacacttcgtccatacctgaattggaatgggccacctgcatcccttgaggaagcggtatccaagttcttctcaaagagctgtgttcccggtgcccaaaaggatagattccccaacctgtgtagctcgtgtgcagggacaggagccaacaaatgtgcctcttcccccgaggagccatactcaggttatgctggagccttgaggtgtctgagagacaatgctggagatgtggcttttaccagaggaagcacggtatttgaggagttaccaaataaagccgaaagggaccagtacaagctgctctgcccagacaacacctggaagccggtgacagaatacaaggagtgccacctggcccaagtcccttcacatgctgtcgtatcccgaagcacgaatgacaaagaagaggccatctgggagcttctccgccagtcacaggagaagtttggaaaaaaacaagcatcgggattccagctctttgcctccccctcgggacagaaggacctgctgttcaaggagtctgccattggctttgtgagggttccccagaaggtagatgtagggctctacctgaccttcagctacaccacatccatacagaacctgaataaaaagcagcaggatgtgatagccacaaaggcccgggtcacatggtgtgccgtgggcagtgaggagaagcgcaagtgtgatcagtggaacagagcaagcagaggcagggtcacctgcatctcattccccaccacggaagactgcattgtcgcaatcatgaagggagatgctgatgccatgagcctggatggaggctatatctacactgcgggcaagtgcggtttagttccagtcttggcagagaaccagaaatcctccaaaagcaatggcttggattgtgtgaacagaccagtgggagggtaccttgctgtagcagcagttagaagagaagatgctggcttcacctggagctctttgagaggcaagaagtcctgccacactgccgtggacaggaccgcaggctggaacatccccatgggcctgcttgctaaccagaccagatcctgcaaatttaatgagttctttagccaaagctgtgcccctggtgctgaccccaaatccaatctctgtgccctgtgtattggtgatgagaagggtgagaacaagtgtgctcccaacagcaaagagagataccaaggctacactggggctttaaggtgtctggctgagaaggcaggaaatgttgcatttttgaaggactccactgtcttgcagaatactgacgggaagaacactgaagagtgggctaggaacttaaagctgaaggactttgagcttttgtgccttgatgacacccggaaacctgtgactgaggctaagaactgccacctagccatagccccaaaccatgctgtagtgtctcggacagacaaggtggaagtccttcagcaggtgctgcttgaccaacaggttcagtttgggagaaatggacagaggtgtccaggagagttttgcctgttccagtctaaaaccaaaaaccttctgttcaatgacaacactgagtgtctggccaagatccccggcaaaaccacatcggagaagtatctgggaaaggagtacgtcatagcgaccgagcgcctgaagcagtgctccagctccccgctcctggaagcctgcgcttttcttacccagtgaaaacactgagcaaatagcag

SEQ ID NO: 155 - DNA, 2619 bp, Rat
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctacagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcatgcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgctgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggctcccctgctgaaggtggggattgcccatccatctgcttacaattccctgctgtcgtcttagcaagaagtaaaatgagaaattttgttgatattcaaaaaaaa

SEQ ID NO: 156 - DNA, 3860 bp, Rat
aagagacctccctgtaaaaagggcagcccacaaacacctcagccttcagaggagactgagctcctcagacgacaagagtggacccgtgtgtctccccaccaggcatggaaccaaagcggatcagggagggataccttgtgaagaagggaagtgtgtttaatacctggaaacccatgtgggttgtactgttagaagatggaattgagttttataaaaagaaaagtgacaatagccccaaggggatgatcccgctgaaaggaagtactctcactagcccttgtcaagactttggcaaacggatgttcgtgttaaaaatcactacaaccaaacagcaggaccacttcttccaggcagccttcctggaggagagagacgcttgggttcgggatatcaagaaagccattaaatgtattgaaggaggccagaagtttgcaagaaaatccacaagacggtccattcgcctgccagagacaattgacttgggggctttgtatctgtctatgaaagaccccgagaaaggaataaaggaactgaatctggagaaggacaagaaagtttttaatcactgcctcacaggtagtggtgtcattgactggctggtttctaacaagctagttcggaatcgccaggaaggcctcatgatctccgcttccctgctcagtgaagggtacctgcagcctgctggagatctgtccaagaatgcagcagatggcatagctgaaaaccctttcctggatagccctgatgctttctactactttccagacagtggattcttctgtgaggagaactccagtgatgatgatgtcattctgagagaagaattcagaggggttatcatcaagcagggatgtttactgaagcaggggcaccggaggaaaaactggaaagtgagaaagttcattctgagagaagacccggcctacctgcactactatgatcctgctgggggtgaagatcccctgggagcagttcacttgagaggctgtgtggtgacttcagtagagagcagtcacgatgttaagaagagtgatgaagagaacctctttgagatcatcacagcagatgaagttcattattacttgcaggcagccacttccaaggagcgtactgagtggatcaaagccatccaggtggcctcacggactgggaaatgaggacaccgagaatcactgaggagcatctgactggccaagattctacaacccatataacagagatggaattcaaggccagactttgaactttgagtcggcattctgttttgtcttcaccttcctcacatgcttttggggtgcatcattttaatgtgttgtttatttaatattcactgaagcaagagttctcaagctttatgggtctgttccccacacaccagcactcaaatcaaacaatattgtgcttgtataactttctatgggaagtctagagactttacagatagtccagaaagtctcaaggctggaggagcatgaggcctttcatccctttgtattctgagttctccttcctgttttcttctcacctgaataaaacaattaccatgacacttcacaccacacataagacatcagcctacaagtgtccattgctcttctgcccttctgctcaatgtcatttctccaatgaacaagaatgtcagctgagtccttagaaaaatctgagcctgagatagcaaggagtgaatgaattgtattaaaaaggggaaagaatgatactaaaatacacaaaagtgctaggaactagaattaggtgaggtaacttcaacgcaagtttaactacgggtttggcctggaaagcatagcaaggggtcatctttccccgaccaaacaggacatcaggtcttctgtcttgtgtggagaagtgactcaaagtgacaatatatttatggtctaatgaacagtaatgtatgctctctctaattgttcagagtcttataaggaaaaaagacagaaagatcagagacaagggactcttgggaagaagcataaggatggacatctgggagtgggtgtaaagtgtgaggatgtgtgtgtcacattctaataatcccagaagcttccatccccaaaccacttggcctgtaatcaccatagccctagcacaaatgacacatgaatggttacccataggtaaccattggtatatcacagtggtggatatagaggtcatatacagggacaacagcattggcttcaactttccaaccttatttagctattgccacctctgagtgtccagcacatgactagtgaagaccagtgctgaacactgtgtggtattcttcaaggaaatgaacaagttatttgataagttggctgtatttcattctgaatactttgtcctcataagacagatgctgaatctagctgtggatttctgtttcttatttagagtattctatttatagacaagggtccacatattttaacgtttagagagttattgtagatgggaaaaggaaatagacccattttttatgggtgtagcacatctttcaatcccttaatccctcaatcacattatctccttgaagtgctgcctagctcaccagttaccaattcttaattcatgttaagaacatccttcttgtatattcacatttctgtgtttagatcagaaccctaccatttactgtgtagattcatttcaagagcttccaaatagacttccataccccataactatactccaatctactttatatatatttatcactaaactctatatggaatagaggaaccttaaatatataatgttgcttatcttccaaactttagctcatctccaatgtttccattgcttgtaccatagaatctaaagttggtgaactgtaaggttaataatgttaatttgactaaactgggagatgcttaatgtgtagggtatcagtttagcacatatgtaaatatgtctgtaaggagaattttaaaagataattaattcatgatagctctgactcagtgaatggatagttgatccattggtagattcaagactattaggaggtggtggaactttgcaagttggaggaagaaggtgggtgtatccttccggaggtatatctgggcttctcctgttatcatcactctgcaatgattcctgtctgccttaatgtgccctgccctggttcactacactcaatgactgtggaggactgaaacgcttaaatttgtgaactgaaaacaacttcttctaagttatttctgatggtcattttgtcacagcatcaaacaaagcacataaactcgtacataagcaagggatgtccttattggtcaaacattaattttcataaaatccaggagtaagatgggaaacttaatataatcttataatgaaacagaaaagtaaacaaatagctggaaaggcaagatgtgtccactggtggcatagggacattacttgtaggggtgtaaccaatggctttctcataggatctgaggcctactctctggaagacaattcatgtactattggtcaaatgcctgtgaatagggaggacataagccctgtcaggaatggtatttctattgttttgctaaatattcatgtcctgcctatcaaattgcccttgaaaagacctctagtttcatgagtcccaaagctaagaatgtcctcagacaaaattcaatgcctactttgctgtaatccttataacctatatgatgtttctaccaatgtatttgggaaaaaaatgccttgatttaggactttgttctgttactgtgaaaatgcacgtaagtgatgcaacactgtagtagggtttttgggaaagttcaatctatattcccaagccatagtcactcatattttgctctagaataaactctaaacttttattcctttgaaggtaaaaa

SEQ ID NO: 157 - DNA, 2745 bp, Rat
ggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaataaggccattaaatgcattgaaggaggccagaaatttgccaggaaatctaccaggaggtccattcgactgccagaaaccattgacttaggtgccttatatttgtccatgaaagacactgaaaaaggaataaaagaactgaatctagagaaggacaagaagatttttaatcactgcttcacaggtaactgcgtcattgattggctggtatccaaccagtctgttaggaatcgccaggaaggcctcatgattgcttcatcgctgctcaatgaggggtatctgcagcctgctggagacatgtccaagagtgcagtggatggaactgctgaaaaccctttcctggacaaccctgatgccttctactactttccagacagtgggttcttctgtgaagagaattccagtgatgatgatgtgattctgaaagaagaattcagaggggtcattatcaagcagggatgtttactgaagcaggggcatagaaggaaaaactggaaagtgaggaagttcatcttgagagaagaccctgcctacctgcactactatgaccctgctggggcagaagatcccctgggagcaattcacttgagaggctgtgtggtgacttcagtggagagcaactcaaatggcaggaagagtgaggaagagaacctttttgagatcatcacagcagatgaagtgcactatttcttgcaagcagccacccccaaggagcgcacagagtggatcaaagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccagcctcagggcctcttctggaaaatgaagaaattcaactagtagattcctgaggtccccctagcttaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacccggggaggccaggagtagctgagggtcctttctgtgcccttaaaccgcccagaggagccctattccactctggttttaggctgatctgagagggtctccctttgttcctttctggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaactagtgattcttctccaaaattgagaaagacagcacccattgaaacagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaataaatatatgactctgtttaat

SEQ ID NO: 158 - DNA, 2531 bp, Rat; identical to SEQ ID NO: 27

SEQ ID NO: 159 - DNA, 3969 bp, Rat
gttttgttcgcttggaaatctccctttctgcttgctcttctgtttgcggtatctacttgaaatcttaccgaagtgatgtatattcttgaaacttctgtgggtttctaagtgacacttgagcatgctccagtagctagagccggttttgttcgccagcagatggcctgattcgacctctccaaaaatagacattttaactctctgaactcctgtttaaggaaggatgtaattcgctttgctctctcctcattttcaaggttcaaagggaagctgcgaggattccaaggtcccaccgccctcacagccaatgaggggcctgggagggaggagcttggtgcagcttgagcttctgagagaatcattcccggtagatgcagcggagtctgagctctgctgcatctgtcacagcagaacaaaattaaaaacacaacagtggaagagaaacgctgcagactatgggacgctgtaggactttctaaaacatttgctggggatttctgtgaagcatgatcttttaaaacgaattcttttggaagccggtttgggtaactgggaaaatgacacatatgctaaatgcagcagctgatcgagtgaaatggaccagatcgagtgctgctaagagggctgcctgcctggtggctgcggcatatgctctgaaaaccctctatcccatcattggcaagcgtttaaagcaatctggccacgggaagaaaaaagcagcagcttaccctgctgcagagaacacagaaatactgcattgcaccgagaccatttgtgaaaaaccttcgcctggagtgaatgcagatttcttcaaacagctactagaacttcggaaaattttgtttccaaaacttgtgaccactgaaacagggtggctctgcctgcactcagtggctctaatctcaagaacctttctttctatctatgtggctggtctggatggaaaaatcgtgaaaagcattgtggaaaagaagcctcggactttcatcatcaaattaatcaagtggcttatgattgccatccctgctaccttcgtcaacagtgcaataaggtacctggaatgcaaattggctttggccttcagaactcgcctagtagaccacgcctatgaaacctattttacaaatcagacttattataaagtgatcaatatggatgggaggctggcaaaccctgaccaatctcttacggaggatattatgatgttctcccaatctgtggctcacttgtattccaatctgaccaaacctattttagatgtaatgctgacctcctatacactcattcaaactgctacatccagaggagcaagcccaattgggcccaccctactagcaggacttgtggtgtatgccactgctaaagtgttaaaagcctgttctcccaaatttggcaaactggtggcagaggaagcacatagaaaaggctatttgcggtatgtgcactcgagaattatagccaatgtagaagaaattgccttttacagaggacataaggtagaaatgaaacaacttcagaaaagttacaaagctttagcagatcagatgaacctcattttatccaaacgtttgtggtacatcatgatagaacagttcctgatgaagtatgtttggagcagcagtggactaattatggtggctatacctattatcactgcaactggctttgcagatggtgaggatggccaaaagcaagttatggttagtgaacggacagaagcctttaccactgctcgaaatttactggcctctggagctgatgctattgaaaggattatgtcttcatacaaagaggtcactgaattagcaggctacactgctcgagtgtacaatatgttttgggtctttgatgaagtaaaaagaggcatttataagagaactgctgtcattcaagaatctgaaagccatagcaagaatggagctaaggtagaattacctctcagtgacacattggcaattaaaggaaaagttattgatgtggatcacggaattatttgtgaaaatgttcccataattacaccagcaggagaagtggtggcttccaggctaaacttcaaagtagaagaaggaatgcatcttttgataactggtcccaatggttgtgggaaaagttctctcttcagaattctaagtgggctctggcctgtgtatgaaggagtcctctataaaccacctcctcaacatatgttttatattccacaaaggccatatatgtctcttggaagtcttcgggatcaagtcatttaccctgattcagtggatgatatgcatgataaaggttatacagaccaagatctggaacgtatcctacacaatgtccatctctatcacatagttcaaagagaaggaggatgggatgctgttatggactggaaagatgtcctgtcaggaggggaaaagcaaagaatgggcatggctcgtatgttttatcataaaccaaaatatgccttgctggatgaatgtaccagtgctgtcagcattgatgtcgaaggaaagatatttcaggctgcaaaaggggctggaatttccttactgtctataacacacagaccttctctttggaaataccacacacatttattacagtttgatggtgaaggaggttggcgctttgaacaattggatactgctatccgtttgacattgagtgaagaaaaacaaaagctagaatctcagctagctggaattcccaaaatgcagcagagactcaatgaactatgtaaaattttgggagaagactcagtgctgaaaacaattaaaaatgaagatgagacatcttaatttgttttgacatattttaaaaagttaattattagataaaggctcaaagacattctgttatactgcatgaagtatgttaagctaagcacagagaaaaaaaggcagcaagacatgttttataagattttagcattaaggaagtatatgatctgacttttcagaagaaaataaacaaatgcattatgtaaggtcagtcattatgacttatactaattcctagtgaaggcctaatgcacttgtaaaacaggattttctaggtgaattcctgatgaataccagatttactatgtatatgtggtgtgtctgaagttcttaacaaacatgggcaatattctggaaatgaaacaagttataactgagcaccatttgggttgataccaagtgcataagattcaaactttgagtgacatttagtccatttatggttgatattaggtttaatacctagaattcaaattgattattgctagtggccaactaaacctgtacaaaatagctgacagttttataactaatttcaatataaaaattgttttaatggcatttgttgaaagaaaaaagcatggctaaaatgtatcaaatgccatatttttaaattttggactttaagcatcttaatgagggcatataacaaattaattttagtacaatcttaaatatttttaataaatcctttcattttaaaaagagaattgccaatacagaaaaggagtatccaaacaatgtctcaacctgataatttccttagcagaattacctattgcaacttctgttcagaaatacacagcttgtttttttgcccaaggatgagtctacattttaagaactgcaatggtataaaggaacttaaggattctgagaatcatagtaataacatacattggaatagtactttataatttacaatccccatttacatcatttcaccttaatgttgaggacaatgttttgaaacaaatactatttttcctactttgcttttgagaaaattgacactcagacttgccctaatcatgcactttacttaaggaaagatcgagaaatcaaatgaagttctcctgactctctggtttagtgctcttttgttattatcctttaaatcaaactgggctataatagcaataaaagttagacgaagtgtagaaaataaaataaatttcataatgttaaaaaaaaaaaaaaaaaaaaa

SEQ ID NO: 160 - DNA, 433 bp, Rat
ctgtgttaagaaatttttattgtttcctttggacaatttttgtgtgatgaaagcacataaaattacaagtggaagaaacatcatgccacaaaattgcatagaatgattacaaaaatgtgaattatgcattttaaataatttcagatagaacccaaatatgtacattttaagagcatcaaatactttgccctctccctccttctcctcttaaaaggcgggaatcacaatgttcaatccattccgaacagtattaacacagtgcacaagggcaacattaaattcaaaggaatgcaagcaatggccctttcttttggaacttaattaatgacttcttatctattacaggagtattaattaatgtgtggtggtactgaaatgttaaaaaacagagcacatgtcatgtcattagaactttgaacactgatttacacgg

SEQ ID NO: 161 - DNA, 3161 bp, Rat
actttctgggaacaagtgcaagacactgacacgcaaggacgtgataaattcctagaaagataaaatatgaccaaaagcaacggagaagagcctaggatggggggcaggatggagagattgcagcaaggggtccgcaagcggacacttctggccaagaagaaagttcagagcctcaccaaggaagatgttaagagttacctgtttcggaatgccttcgttctgctcacggtcactgctgtcattgtgggtacaatccttggatttgccctccgaccgtataaaatgagctaccgggaggtgaagtacttttcgttccctggggagcttctcatgaggatgctgcagatgctggtcttgcccctgatcatctccagtctcgtcacaggaatggcggccctagatagtaaggcatccgggaagatggggatgcgcgctgtagtctattacatgactactaccatcattgctgtggtgattggcataatcattgtcatcatcatccaccccggaaagggcacaaaggaaaacatgtacagagaaggtaaaatcgtgcaggtcactgcagcagatgccttcctggatttgatcaggaacatgttccctcccaatctggtagaagcctgctttaaacagtttaaaaccagctacgagaaaagaagctttaaagtgcctatccagtccaacgaaacacttctgggcgccgtgatcaacaacgtgtcagaggccatggagactctgacccggatccgggaggagatggtgcccgtgcctggatctgtgaatggggtcaatgccctgggcctagttgtcttctccatgtgcttcggtttcgtgatcggaaacatgaaggagcaggggcaagcgctgagagagttctttgattctcttaacgaagccatcatgcgattggtcgcggtgataatgtggtatgcgcctctgggcatcctcttcttgatcgcagggaagattgttgagatggaagacatgggtgtgattgggggacagcttgccatgtacaccgtgacagtcattgtcggcctcctcattcacgccgtcatcgtcctgcctctcctctacttcctggtaacccggaagaacccctgggttttcattggagggttgctgcaagcgctcatcacagcccttgggacctcctcaagttctgccaccctacccatcactttcaagtgcctggaagagaacaatggtgtggacaaacgcatcaccagatttgtgctccccgtgggggccaccattaacatggatgggaccgccctctacgaggctttggctgccattttcatcgctcaagtgaacaactttgacctgaactttggacagattataacaataagcatcacagccacggccgcaagcatcggggcagccgggattcctcaggccggtctggtcaccatggtcatcgtgctgacatctgtgggcctgcccacagatgacatcacactcatcattgcagtggactggtttctggaccgcctccgaaccaccaccaacgtactgggtgactccctcggagcagggattgtcgagcacttgtcccgacatgaactgaagaaccgagatgttgaaatggggaactcggtgattgaggagaacgaaatgaagaagccgtatcagctgattgcccaggacaatgaaccggagaaacccgtggcagacagcgaaaccaagatgtagacggacagagaagtgctttcttaagcaccaagtgttggaaactgttctacaatgtatccatctccctgggctcactttcccagtgagctcctctttcctccctactctgataggattggaaaacggccaaacacaaaggagggctctgcagcagcccaaacctatcggttttagcctacatttgaaaattttaagtcatttcatattattcttaccaagtaagctactacaatcaaacacagtttcgatattaccaatttaggtggcaaacgatcctgtgccattgctctgtaagtaaaagaattaagcaaatgataggctaccgaaaaaaaaagttttaaaatcaactttcaagatgtaaaaatccttcagaatgcaactgagttttaatcttaaaacattacaacttgatgagcaattatcagttacccattgagtagctgagaggttcccatttcttctgactcctgccctgactttgtcagcatcagggcaatccccacatgcacacagcacagctgtgaggaggagcggagagtgaggctcccaaatggtctagagtgagccttgtctcatccattggcctcagtgttctcatccggaaaatgagtgactcctagacaggcctctctagcccaaacttctggaacatcaggaaggaccctgcccctgtacaccatgaggatctcagacaggacacttattgggaatggacatttctctctaggggcaggctgtgtgtggctcactagatcctgggttcaaaatgttcgttctatcagtagacaggtggaaggccatcctagaaggcctattgtcctgttttgttttccaatactagaggccctcccttctggggtacacttcccaaatccaagggaagacagtctcttcaattagatgtctaggaaataaagagaagactagcaagtgtgctcaagtcttagtgtggaacactaaagagtggagaaagaatagagtatggccaacattacaaaagggaggattctttgaaagatcaggaaaagttggttttctttaaagactaaaatggagagctatatctcaaccctttttctgttagcctaaacacttcctcttcagtccctaatcagcccccaaagaaacgacgtcataacaccacttcctcctcatctcccagtccaaccaaccacatctctgggacagatccatacgctgggtggatggtctcatttctgaaaaagattttttttttttggtttttttatttgttttgtttttactattttaaccaggcgttcttaggatgacaaaaacaacatactcttttttgtatagagatgtctcttgacaaatcattcaaaagtctcatctagagtggagtgtgcttgtttatgtccctaccaaaaaaaaaaaaaaaaaaagacagatgaatcagcatgaggataacatcactgaggatggaagaaaacacagcagga

SEQ ID NO: 162 - DNA, 3871 bp, Rat
gcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaattcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtagtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 163 - DNA, 2547 bp, Rat
atggcggcggcagcgcctgctgcggcggcggcttctcccgaggcgccggccgtctcgggcagcgcagacccggagacgggagacgaggacagtcgtgaggtccgagtgctgcagagcctgcgcggcaggatctatgaagcaaaaaatttattgccatatcttggacccaacaaaatgcgcgattgtttctgcactataaatttggaccaggaagaagtttatcgcacccaggttgttgaaaagtctttaagtccatatttcagtgaagaattttattttgagattccaagaactttccagtatttgtctttttatgtttatgataaaaatgttttacaaagagatcttcgtataggaaaagtagccatcaaaaaagaagacttgtgcagtcatagtggtaaagaaacttggttttcactgcagccgattgactcaaattcagaagttcagggaaaggttcaccttgagttaagactgaatgagctgataacagagaatggaaccgtgtgccagcagcttgttgtacacatcaaggcctgccatgggttgcctctcataaacggacaaagctgtgatccttatgcaacagtgtccctcgtgggcccctctaggaatgaccaaaagaagacaaaagtaaagaagaaaacaagcaatccacagttcaatgaagtcttctattttgaggtaaccagatccagcagttacagcaggaagtcccagttccaggtggaggaggaggacattgagaagctggagatcaggattgacttgtggaataatgaaaacctagtccaagatgttttcctgggagagattaaggttcctgtcaatgtgttaagaagtgattcctttcatcaagcctggtacttgctacagccaagagacaatggaaacaaatcatctaaaaccgatgacctgggatctcttctgttaactctctgctatacagaagactgcgtgcttccatcagagtactatggaccgctgaaaactttgctgctaaagtcaccagatgttcagccagtatccgcctcagctgcttatattttgggtgaaatatgtcaagatcaaaaggatgctgttttgccccttgtacgactgttgctgcatcacaataaacttgtcccttttatcactgcggtggccgagctggacttgaaggatactccagatgccaacgcaatatttagaggaaactccctggctacccagtgtctgactgagatgatgaagatagtgggagggcactacctgaaagtcacgctgaagcccgttctagatgagatatgtgaatcctcgaaatcctgtgaaatagatcctgttaagttgaaagagggagataatgtagagaataataaggagaatctgtactactatgtggacaaagtattcaatacaatcgtaggatcaagtgtgagctgccccactgtgatgtgtgatattttttattctctgaggcaaatggctgctaagaaatttcctaatcaccctcatgttcagtactctgcagtgagcagctttgtcttccttcgtttctttgctgtagcgatactctcacctcatgcttttcatttgcgacctcattatccagatacacagacagttaggacattgactctcatctcaaaaaccattcagattattggaaactggggatgtcagtccagaaaaaagtcacggttcaaaaagtcagtcatgtgtgaatttctcaaaatgtttcaagaagaaagatattttacagatgtgaaaaagttcttggatgaaatttcatctacggaaactaaagagtccagtggtacgagtgagcctgtgcacctgaaagaaggtgagatgtataagagagctcaaggaagaacccgtattggaaagaagaacttcaagaaacgatggttctgcttgacgagcagagagctcacctaccacagacagcaaggcaaagatgcaatttacactattccagtaaaaaatattcttgctgtggaaaaattggaagaaggctctttcaacaagaaaaatatgttccaagtgatacatacagagaaaacgctgtacatccaagcaaacaactgtgtggaagccaatgagtggatagatgtcctgtgcagggtgagcagatgcaaccacaacaggctcagctctttccacccctcagcgtatctcaacggaaactggctctgctgccaggagacgagtgaaagcacaccaggctgcaagccgtgcaccgcaggcatccctgcagacatccagatagatatcgatgaagacagagaaacagaaagaatttattctatttttaccctcagtttacttaagctgcagaaaatggaagagacctgtgggtctatagctgtgtatcaggggccacagaaagaacctggttattctaagttcaccattgaggattctgttgcaacctttaagacaattcagcaaatcaaaagcaccatagagaagctcgatgaacctcatgagaaatacagaaagaaaagatcgagtagtgcaaaatacggaagcaaggaaaatccaattgtgggaaaaatatcatag

SEQ ID NO: 164 - DNA, 2592 bp, Rat
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaagtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttt

SEQ ID NO: 165 - DNA, 1168 bp, Rat
tggccagaggccgagtctgggcttccctgtggggcgtccgccagagcggcgcggaggtctcggttgagaggagctgtggcgtgttcctcgcggggagagagagagagacacatcagccaatgtccctccattggaatcccgactccagcccgggagcaatcgcgtagcccgatcacccaggaagagaaattgtaagcagataagaagaacgcgttcagtttgagacaccatttgcagctggaaatggggaatggactgtcagaccagacttccatcctgtccagcctgccgtcctttcagtcctttcacattgttattctgggtttggactgtgctggaaagacaacagttttatacaggctgcagttcaacgaatttgtaaataccgtacctaccaaaggatttaacactgagaaaattaaggtaaccttgggcaattccaaaacagtcacttttcacttctgggatgtaggtggtcaagagaagttaagaccactgtggaagtcatacacccgatgcacagatggtattgtgtttgtggtggactctgtcgatgttgagagaatggaagaagccaaaactgaacttcataaaataactaggatatccgaaaatcagggagtccctgtgcttatagttgctaataaacaagacctgaggaactcgctctctctctcagagattgagaagttgttagcaatgggggaactgagctcatcgactccttggcatttgcagcccacctgtgcaatcataggagatgggctaaaggaaggactcgagaaactacatgatatgataattaaaaggagaaaaatgttgcggcaacagaaaaagaagagatgaatggcagtaccttttatattggtgtggaataggttttcctgggtctgatttctgacaagctgaagagtgtctacagcctggtttgcctgtctgccctcatggatgctattaaagctttgttttgttgaacagtcagatacccaactctgttgccttgtggaagatgagtcaatgcaatgcttcttaaagtggtctcttctccctgacccacaaatcttttggtactaccattttgggaagtcaaaaaaggctagtaattgaccagaaaacaattttgtggaaatttgacctgaagttagtgaaataaaactttgaagagtgt

SEQ ID NO: 166 - DNA, 3875 bp, Rat
ggtggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcaggtgagccgcggcggggtgggcggccggggcggccacgccctgccgagggagaagagccggtcgtgtgcggagggacagggtgaagagatcccacttcggggaggatgggcttatcccggcgggcgcgccaggtgggatctctagcgcctcaggggcccgcgcggcaacagccggcaccctcgggcccgcggacaaagggttaacgcgttggcagtgactgcgggccccggatgtgagagccttggcttgacgccctggctgcgctgcaggtgcgccgggccgaacggagccggcagcctggcggcgacctgaccgcccgaggctccccttcacctgcagcggctgctcggctccctctgggaacgccgccttttctaacttaagggcaacaggtggtgccggtggaccgagagagagctcagctccgccgcgctgggagcggcagttaccctcaccaattagggagcgggggcgggagttgcatggcttccctgatgcgggtgaccaatgggatttgggatcatgagtggaccgggaggagtgggcgtggtcggagtctgagtccaaggtttctcgtgcggcaactgccagagctgcttggagagctaagctggaagggtgcttatccctgcgtagaaacgcctgccaatgctttctcatttggacccagactccagatcgggaggtgagaacgttgttattttgcaaggggtaggaggtaatagtgatcttgggtatgctgttaagcatgtggaattagattccgaagataggactatctgctatgagttttctgccagataggcactttgtggttacggccacttagaccagatactggtgactgggttctttccagaatgaggtctttgaggtttggggacccaggagaaaaacgtacatattactgcaatttaagtaaaccagataatttcaatcactgttattccatcgtttgtcttggactgtgtgtgttttcatgtacgtttcatatctcgtctggtttgtttagcgcagcaagttatagtaagttcttcgtgttgtttattttagcaaagtagagcaaacctgttttaatgtattatttcgggagaataacttattccttcttccgtctcccagcagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcagtacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttttctcccttcactgatacttaaatcatggtatctgctgcaaacatgagtagatccttgatggattaataaagcttgctggaaaaaaaaaaaaaa

SEQ ID NO: 167 - DNA, 3996 bp, Rat
cggcacgagggcggatcctcctggggaggccgggccggggagcgggttcgggcgccgagcggcggggccagcaggcgggcgcggcgagccgggccagggcggggagcggggcagagatcgaagcggcggcggctgcgccccgggcccgccgcaccttctcctccggtcaggggaaccgctgcatggggccgggagggcggccctgctgcgccgagcggcggcgacggcggaccccccaagcgggctggggctgagcccggggccagggcgggggctccggggggaccatgccccgaggccggccggccgcagcatggctcacgggcccggcgcgctgatgctgaagtgcgtggtggtcggcgacggggcggtgggcaagacgtgcctgctcatgagctatgccaacgacgccttccccgaggagtacgtgcccactgtcttcgaccactacgcagtcagcgtcaccgtggggggcaagcagtacctcttgggactctatgacacagctggacaggaagactatgatcgtctgaggcctttatcttaccccatgactgacgtcttcctcatatgcttctccgtggtaaatccagcctcgtttcaaaatgtaaaggaagagtgggtaccagagctaaaggaatatgcgccaaacatccccttcttgttaataggaactcagattgatctccgagatgaccccaaaactttagcaagactgaatgacatgaaagaaaaacctgtctgtgtggaacaaggacagaaactagcaaaagagataggtgcatgctgctatgtggagtgttcagctttaacccagaagggtttgaagactgtgtttgatgaggctatcatagccattttaactccaaagaaacacacagtaaaaaaaagaataggatcaagatgtataaactgttgtttgattacgtgagaaacatctttagtggccaaggaaactgtccatttctcccagaaagcatttgaaatgctacagcgctatcctgacctcttacagtgaagcagtttaacttgaggagggagggaacctgtcctcagcattctacagagttcattgagaatgtttcagaaaggtctaagcggcagcgaacagcatctgaagccacaatctactataaatactttatttcaactagaaggtacaatctctcaggggtttcatagttaaaaagctacaatcacatcatgttgaaatgacatttagaaaacaacagtgctgtaaatggactgcccggcttggaccatgtaacttctgcacagcccttatggaatctgcacagagaaataacttctctcctttctcctcttaattgttcttgtatgtaagctgctttctattccagtagatccagagtggcgagataaccaggccagccacgtagccaaaggtcgctccgagtgtacaggagatgggccacacctgaggaaagaattgagatctaaaccaaccgatgctttattatacttgagcacaaatgaagtgtaacacaaacctttctatagtgaagcttagtgtgctttcttaaagaatgccaagttgaatagatcataactgctttgatcatgaacactaaaaatgtacacattttagttaatgtgcattaaacagtaacaaggcttctggcaactgtagattttagtttgatgttatccaaattgcatgaaatacatgctaaagtaacgtttaaaaattgggtcatagtttgccataatcctgaactcagtttagctctctgaattagttggccattttctaattcccacattggctgtatacatcaaatgaagtaagtgtataggctgaccgattctcagaaactctcagtcgtgtcagagggaagacctggaatctaagcgcgtcctgtgggatttgtggatatctgcttccatagtaaaactgatgtccgcttggagctgcagctagcacatccacagcagaaggcacaacccacagcttacgcacacacctagtgagaggcgagcagagcactgctgccttcccaagacccttcctccagccacgctacatttcactaagccagagataataatggtgacttttctttgtaatgccacagacagggtatgtgtggaatgtcttggaaacaaactttcatgctcctttgtaaagcttatttggtgtaccgcagccatttctaacccttctccggggaataggccatcaaagtgtactgcaggcaaaccatcttactaactggctggaacctcatttggctttcttcttcggtctgctatggatctgccttattctaaatgccatgcaacagacagtagtgtagacaaagctcccatgggaaccacctcctgcagtggagggaagcagattctaacccaggcattcttaccagccttctttaggttcaaatttgcagttgcttaaactacgacttgtctttagcaagcttctgttatcttccatggtttgtgcttaagctttgtctattgcacagattgggtaatggaacactaaacatttatacttgaaaatgacagccttaaatgttcataccagtcacaaatctagatgtactgtcttgcatgtgagctttgtaggagtttttaaaatataagcaccacactccccacttggtagtggacagtctactggacaagagtgttctcctggaagtgggcacagtatgtcttcaggcagtggtggttcacattaagtatatcatggccttatgtatgctcaaatgggacttctgtaattttcccatttagttttggtctgtttttagatagaattggaagaaactgtatagttaacatgagctaagttgtcaaacctatgatctgaaggaaccaagacagtaaagtattattcgtttccaagttgcctgtggagatttgatggcttgttcttttcttcaaatccacatctgtgaaacccttgacacttggtgttggcaatgagtttaagtcaaggactttcctgctccaagagaaacggattcagaatctgaacgtgcactggtgtcacctcagtctcctcatgtttgatcacggggacaacctcgtgtcccagtcattcatgagctctgagcactctcctccgactgacagcagtcatggctggcctccaccttctccagatggtaagaccttgtacatagaccacgtgaactctcgcagacggctgcatcacccgaacctgaggtgccttaggtgctctatttacctggatggggctcggagtttcccattgcttgttaagagctctttgtgtttgttatttagtatttctttttgcaaaaccttctctgccactttaaccagaaaaccaaagatttgttttctattcatgagcagattatagagacactgccttattttcagacgcatatagcttcattaatggcttaggttgcagaagaaattcagactagtctctgaaataactctttcaaactagtgaaatatctgggaaagaaaatacttttcaaaaatattttattaacatgaactgtgttagtgagcacactgcttcaaataaggtcatgtgtgaaagaacattcagaaagttatcctatctcagcgattaagattggtaactgtcagaccaagtttttaaaatttttagggaaatcttgaaatcttacagcacttactttgctaatgtatgcccttatctgtccttacaggtacacgtagcttcctcgtggtgatttataacaaatagcatgaacgtagcttcctcgtggtgatttatcatattacatacgtagagcttgagttcatgctatttgttataaattatcttagttactttagacactgcttccgtttgatttttaattattggttttaaataccaaattaaatgctggtttgttggttgttgtttttaaatgattgttccttcaacagcatcccctcctgacggatggggtcataataaaatgagatgcgtagtttactgttttatgtaaagcaaaaaaaaaaaaaaaaaaaaaa

SEQ ID NO: 168 - DNA, 2711 bp, Rat
accccccaggcgggccggggctgagcccggggccggggcgggggctccggggggaccatgcccggaggccggcgggcagcagcatggctcacgggcctggcgcgctgatgctcaagtgcgtggtggtcggcgacggagcggtgggcaagacgtgcccactcatgagctatgccaacgaagccttcccggaggagtacctgcccaccgtcttcgaccactacgtagtcagcgtcaccgtggggggcaagcagtacctcctaggactctatgacacggccggacaggaagactatgactgtctgaggcctttatcttacccagtgaccgacgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaaggatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaaagaataggatcaagatgtataaactgttgtttaattacgtgagaaacatcttcagtggccaaggaaactggccatttctctgagaaagcaaatgaaatgctacagctatacccagaccttttataggtaatgaagcagttcaaaacttgaaagaaaacaaaacctgtcctcagaattctataaagtttattaagaatgttccttaaaggtttaagaagcagtaagcagtatctgaagccacaatctattataaatactttatttcaactagaaggtacaatctctcagaggtttcatagtttaaaaagctacaatcacatcatgttgtaactacataaaaaacagagctgtaaatggaactgcttggctttgaccatacacatttctgcacagcccttacagaatctgcacaaagaaatatctccctttgttccggttaattgttctggtatgtaagttgctttctattccagtatatccagagtggtgaaataacaaggccagccacatagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgcctaaagtgtaataaggtcataactgcatttatcatgaacactaaaaatgtacacattttagttagtgtgtattaaactgtaacaaggcttcgggcaattgtagatttagtttgacgctccccaaagtgcatgagacacatgctaaaattacaaattaaaattttgggtcagactttgccataatgctggactcaatttagctctctgaactagatggtaatttttttttaattcccactttggctgtgtacatcaaatgaaatgagaagtgtgtatgctgaccaaaccacaagaaactttctttaagttgtgttaaagaggaaagacctagaatccaagcatgttacatgaaaattgtaacagagcagctgcttccacctttcagatatggatgttggaaccacagcagaagttatagagcgacaacttacatacacacctagaatgtaagttaaacaaaataccggcttcgggagacccattttctccagccatattacattaggctagaagtaattaatgttgatttatttcatctacaagcagttggtccctaagtgacaggctccgcttcaaaaaaaaaagttggagaaaaattttcatgttcttctgtgaagcttatttggtacactggagccttttctaatctttctctggggggaacaggccgcagaactgtgttagaggtgaaccatcttaattactagttctattacctaattcagcttccttgtttggtctgctgtggatctgccttattgcatatgccatgcatcagataatggtgttagacaaagcttcattgtgaacaacctaatgcattttagagaaacaatctcatctacacattttttttctagcctttcctacatttaaacttgctgttgcctaaatcataattttttaaatgtctttggtgggcttctgttaattcacatgacttgagtttatagctgtgtctactgcacagattgggtaatggaacactaaacttttatacttgaaaatgacaggcttaaatgctcatatcagtcacaaatccaggatgtactgtcttgttgtatgtgagctttgtagagatttttaaaaatataagcatcaccttcacattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgctatttttagataaaattgaaaggaattgtataaatcaattaacatattagctaagttgtccaacacatgttataaatgaattacaacagtaaactattatacatttccaa

SEQ ID NO: 169 - DNA, 2385 bp, Rat
accttctggctcgacagatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacatagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccggggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctataagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacattttccaaaagggcagtgcactcagaacttcactgtacctgggatttttaattcctcttgcagtgttgaccagcagagagacttgaggctactttaagcctccactatgtgtttgtagataaaattctcaattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttcgataagtaaatggattttgaagtaaaaaaaaaaaaaaaa

SEQ ID NO: 170 - DNA, 6268 bp, Rat
gtgtgagcagagcttttggcagccagtctgaaccctcagaagaattctcttcagaaaccagagtaaaacagaaccaaccgtccacgataaggaaaatcaaaatcaacatgtagcagtgactcgaaagaagaaacgggacttctcctccgggacaaagatctgtggatggacttctagaagattcttgcttcggcttcctcagaactttcacatctacttccttgatgtcctttaacaaaacaaacaagtcaaaatgaggaagagacacttgagactgggtcagcaaatgtgggcgcttctctgcaagaactggctcagaaagttcaggatgagaagagagaccctcctggaatggcttttctcacttcttctaatattgtttgtatatcaattatcctccaatttgcatcaagttcatgacactcctgaaatgtctgtggtggatctgggacgtgttgataactttaacgattctaattatatgatggtgtttgctcctgagtccgaagccacccatgagataatgaacaaagtggcctcagctccattcatgaaaggaagaacaattgtggcatgtcctgatgaaaaatccatgaatgagctagacttaaattactcgatagatgcagtgagagtcatcttcaaggacactttctcatatcatttgaaattttcttggggtcagaggatccctaaaacaaaagagcacaaagaccattcagctccttgtgaaccactgaacaataaaatgatttgtgaaaactcagccttctgggaaaagggctttgtagcctttcaagctgccattaatgctggtatcattgagatgatcacaaaccactccgtgatggaagagctgatgtctgtcattggttccaatatgaagatgccgccttttattgcccaaggaggagttgcaactgatttttttattttcttctgtgttatttccttctcttcacttatatactatttatcagtcaatattactcaagaaagacagtacatgacaacattaatggcgatgatggggcttcgagagtcggctttctggctttcctggagtctgatgtatgctggctttatccttgtcgtggctgttttgatgtctcttattgtgaaatctgcccaagttgtcgtcttaactggtttcatggtggtgttccttctgtttctcttttatggcctgtctttgataactttatctttcctcatgagtgtgttgataaagaaaccgtttcttactggcttggctatcttcatccttaccgtcttctggggaagtctgggattcacagcgttatacaaacatcttcctgcctttgtggaatggaccttgtgttttcttagcccctttgcctttaccactggaatggcccagcttatacatttggactatgatgtgaattctaatgtaaatttgaactctccaaacaactcgtacctaatcatggccacgctcttcatgctggttttggatgctcttctctatttggtactggcgttatattttgacaaaattacactcagtaagtacggacatcaacggtctccattgtttttcctgaagtcgtcttactggtttaaacgcagaggagctagtcacgtggtccttgagaatgaaatagattcggatccctcgctgaatgactcactggaaccagtgtctccagaattccaggggaaagaagccatcaggatcaaaaatcttaaaaaagaatattctggaaagcatgggaaagtagaagccttgagaggtctggggtttgacatatatgaaggccagatcactgccctccttggtcacagtggagctgggaaaaccaccctgataaatacactcagtggactgtcaccccctactacaggttccgtcaccatttataaccagacagtttcagagatggacgactctgacgccgtcctcacgatcactggagtttgtccacagtccaacgtacagtttggctttctcaccgtgcgagaaaacctcaggctttttgccaagataaagggaattttgccacatgaagtggaacaagaggtacaacaagttctacaggacttagaaatggaaaatattcaagacattcttgctcagaatttaagtggcggacaaaaaaggaagttgactcttgggatcgccattttaggagacccccaggttttgctcctggatgaaccaactgctgggttggatccactctcgaggcatcgcatatggaacctactgaaagagaggagagcaggcagagtaattgtcttcagtactcagttcatggatgaggctgatatcctggccgacaggaaggtgtttatatccaatgggagactgaagtgtgcgggctcttctctgttcctgaagaagaaatggggcattggctatcatctaagtttgcatttgaatgaagcgtgtgatccagagggtataacgtcactggtcaaaaagcacatctccgacgccaggctgaccacgcaaagcgaagaacggcttgtctatatcttgcccctggaaaggacaaacaagtttccagacctttaccgggatcttgatagatgttctaaccaaggcattgaggattatggcgtttccatgacaaccctgaatgaggtgttcctgaagttagaagggaagtcgatggctgatgaatcagatgttggaatttgtgggcgcttacaaagcgatggggcaagagacatggaaagcctcgttgagctggagcaagtgttgtctttagattcgtcaggaagctcagtgagtggcatggcgctgtggaggcagcagctctgcgcagtcgcgaaggttcgcttcttcaagctcaagaatgaacggaaaagtctgatgactgtgttattgctttttggcattagctttgtcccccaacttttggaacatctcgtctacaaggtataccacaaaagttattcatgggggctatctccaagtatgtatttcctttcaccaggacagccaccacaggatcctctgacccacttactggtcatcaatagaacaggttcaagcatcgataactttgtacacgcactaagacagcagggcatagcattagacctggatgccctggggaccagaaatggcacagaagaggcgctgtacaatggtgctatcacggtgctgggtgaagaaaaggctctcagattttccgtagcgtgtaatgccaaaagactaaactgcttcccagtcctcatggatattattagcaatgggctgcttggaatatttaactcttctgaacgcatccagaccgacagaagcacagtctttgaagaacacatgctttatgagtacggattcatgagcaacgcatttttctggataccagtggctgccagcctcaccccttacattgcgatgggcagcatcagtgaccacaaaaaaaaagttctttcccagctgtggacttcaggcctttacccgtctgcttactggtgtggacaggctctggtggacattcccatatacttcctcattctctttctcatgcaaataatggacagtgtttttagttctgaggagtttatatctgtgatggagagcctgttgattcagatcccatgtagtattggctatgcatcatctctcatattcatgacttatgtgatttcattcatttttcgtaatggcagaaaaaatagtggcatctggtcatttttcttcctaattgtcaccatcttctttatcattgctactgacataaatgaatacggctttctagagctgctaatctgcacctttttagtccctcctttcacactgattggctcactattgattttttctgaggtttcctatgactctgtggattacttgggaacgtcagaatctcaactcgtatttctggcattgctgataccttaccttcactttcttcttttctttttcattctgcgatgtctggaaagatacctcaggaagaagtcactgagagtggaccctgtgttcagaatttctccgagaagttgtcctgctgttccgaacccagaagagcccggagaagaggatgaagatgttcagatggaaagagtgagaacaacgggcgccatggctaccctacagactgatgagaaaccagtcatcattgcaagctgtctgcggaaggaatatataggcagaacgaaaaggtgcttttccaaaatgaagaaaaagatcgccacgaggaacatctccttctgtgttaaaaaaggtgaagtcctagggctcttaggacacaatggagctggcaaaagtacaacaattagcatgataacaggagacacaataccaaccgcaggtcaggtgtttttgaaagggagcggtgggggtgctgccctcggattcttggggtactgccctcaggagaacgtgctgtggcccaacctgacagtgaaggaacacctggagttgtatgctgctgtgaaggggctgaagaaaaaggatgctgtggtcaccatcacacggttggtgaatgcccttaaactgcaggaccacttgaaggctcttgtcaggaccttgtcagagggagtgaagagaaagctgtgtttcgtgctgagcatcctggggaaccctcctgtggtacttctggatgagccatcgactgggatggaccccgaagggcagcagcaaatgtggcaggcgatccgagccactttcacaaacacagagcggggcgccctcctgaccacccattacatggcagaagcagaggctgtgtgtgaccgtgtggccatcatggtgtctgggaggctgaggtgcattggttctatccaacatctgaagagcaaattcggcaaagattacctgctggagatgaaggtgaagaccccctcacaggtggaacccctgaacacggagatcatgagactgttcccccaggctgctcggcaggaaaggtactcctctctgatggtctataagttgcctgttgaggacgtacgacctttatccgaggctttcttcaaattggagagattgaaagagaattttgacctggaagaatacagcctctcacagtctactctggagcaggtcttcctggagctctccaaggagcaggagctggacgactttggcgaagaagccaattcctcagtgaaatggaagctcctcccacaggaagagctgtaaagttcaaagtcctctctgtatcctcaagctcacatccctcttacagacagtatatttaagagcatcactgtgccttacttggtcggtgtgcaaacagcttagaacacgcagccagactacgctcaatcaagtcacgttgcacacagtgtggagttttaaactgcatttacaatagtattgatgcttctgagcatgctaaagagactgattgattttcttcgcctgaacttcaaaacattaacttttttctttcctccgtgtctaggtaaggtataatgtaaacaatattgattttagggagaagaggatcaattgatttcccaacagcacagtatttgtttttttgtgtaactcaccctgacctgtctgtcattcactagttctttactcacagtttgcccactctgagttacggagaaatgttttgtccactgtgactgactgcggaagcaactttaaactggtggacgtaaatacttgcaaccattaaataactgtgtgcatgtttacatacgaatctgaaacatttctgaaattttgatttgggaaaaagtaatgcagaggaggggtactcttaggtccaaggactggctttgtatgtatttatttaccaagtctgtgaatgctacaacctctctactgcaacatcagtacagttacctggactcttatctaggagatttttttgttgttactactagtattgttactaattaaccaaacatctatatgaaattataagttaatatgaaaaaattatatgaaaaaaaattcccttgatgctaagattgtaacttcatagtgtatgtgaatatcaactgccctcaacttacaaggagacttctcaagtagactttgagcaaaggctctaagcctttaaagttaaaaagagacattaatgctggacttgctgatgtacctgctttatgaataacaacttaatccgtacacatcaatgcattaaaaacactttatttagggtcagaaaactgcctcagctggttaaggtgcccagttgtcaagtctgatgtccagagtttgatccttgggtgggacccaaattgtggaaggagagaaccatcactcaagctgttttctgatctccacatacatgtagtgtcaggcgtatatgtctacatacct

SEQ ID NO: 171 - DNA, 6112 bp, Rat
attcacaatgaatgtgaaattaaaagcatgatgtagtagtgacccaaaaggaatgtgaattctcctccagaacatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaaatcctgtgtagtattggctatgtctcatctcttgttttcttgacatatgtgatttcattcatttttcgcaatgggagaaaaaatagtggcatttggtcatttttcttcttaattgtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgtgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcggtgaagtggaaactcctcctgcaggaagagccttaaagctccaaataccctatatctttctttaatcctgtgactcttttaaagataatattttatagccttaatatgccttatatcagaggtggtacaaaatgcatttgaaactcatgcaataattatcctcagtagtatttcttacagtgagacaacaggcgatgtcagtgagggcgatcatagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttatttttttgattaaagtataaattaagacaccctattgacttccgggtaaggggagtcaattgattacccagcagcacagtatttgctttttataattccctttttaaatacttgttcttaattcactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaataatttcagtaagaaaaaaaaaaaaaaaaaaaa

SEQ ID NO: 172 - DNA, 442 bp, Rat
gtgggaatcaagccatagctttcttagggaagcactggccaaaggaaggggactcctagagttgtaaccttcctcacagaagacaagaaaatgagttggggtatcagcctcaggctagacagagagccagaacctcttcacagattcccagatcaccggagaagtcactattgaatccggacacccagtcaggcacaagaggtctacattctctaactcctttccagtgcttccccaacggtcacttacttccagactgcgtgttttatttttaggagagatgtgtatattttttgttgctgttgttgtttctagatagggtctcactgtgtagccctggcttttctggaactcactgtgtagagcaagccagcctcaaactcatagatccacctgcctctgcctccagatcgctagaattaaagttactgccataacacct

SEQ ID NO: 173 - DNA, 871 bp, Rat
aaacatggcgctggctagcgtgttgcagcggccgatgccggtgaatcagcacgggttttttgggctcggaggtggtgcagatctgctggacttgggtccggggagtcctggtgatgggctgagcctagccgcgccgagctggggcgtcccggaggagccgcgaatcgaaatgcttcacggaaccaccaccctggccttcaagtttctccatggagtcattgttgcagcggattcccgggccacagcaggtgcttatattgcttcccagacggtgaagaaagtaatagagatcaacccgtaccttctgggcaccatggctgggggtgcagcggattgcagcttctgggagcggttgttggctcggcagtgtcgaatctatgagcttcgcaataaggaacgcatctcggtcgcagcagcctccaaactgctcgctaacatggtgtatcagtacaaaggcatggggctgtctatgggcaccatgatctgtggctgggataagagaggccctggcctctactacgtagacagcgaggggaacaggatctctgggaccgccttctcagtgggctctggctccgtgtatgcttacggcgttatggatcgaggctactcctatgacctgaaagtggaggaggcctatgatctggcccgccgagccatctaccaagccacctacagagatgcctactccggaggggcagtcaacctctaccacgtgcgggaggatggctggatccgggtgtccagtgacaatgtagctgacttacatgacaagtacagtagtgtatctgtcccctgagggaaggtggatgcggttgtctgcatctctaggtgggtctccatggctataataaataatagtacctctttc

SEQ ID NO: 174 - DNA, 1050 bp, Rat
ctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaaacattacactactcactactcaatctca

SEQ ID NO: 175 - DNA, 1347 bp, Rat
cagctcgggcgcggggcttctaaccacgtagcaggcttctatcaccggcttgccagtcgtagcccaacggacaggagggaacatgggggccctggcagctaggcgctgtgtcgagtggctcttgggcctctacttcgtctcgcacatccccatcacgctgttcatcgacctgcaggcggtgctgccgcccgaactatacccgcaggagttcagcaacctgttgcggtggtactcaaaggagttcaaagaccctctgatgcaggagcccccagtgtggttcaagtccttcctgctctgtgagcttgtgttccagctgcctttctttcccattgcggcatatgccttcttcaaaggaagctgccggtggatccgaatccctgcaatcatctatgcagctcacaccataacgactttaattccaatcctctacacactcctgtttgaggatttctctaaagccgttgctttcaagggacaaagacccgagagtttccgtgaacgactgaccctcgtaggtgtctacgccccctatttaataatccccctcatactcctcctgttcatgcttcggaacccgtactacaagtatgaggagaaaagaaagaaaaaatagggacggccaccagcctggtggggaagaccccacagcacagttgccttttggacaacacaggaaaactgccccaaacatgtttcagcagcatttgaaacaccaacagcagtgcatacaaacaagacagtggtgggagacgtgccaggccttcacctttcagcaggggtgtgaccaagttacagcaaaatggtgccaaagcgctaccacagcactgctaaaaaggccaggtgggaagccggttagctcctgacctggaatgcacacacctgaccaagtcctcacctcgaccttgatagtcaacaaatgagcagtattttgtctctttagcactttttaacatggtttcctgcccacacctccacctctgggagaaaaatatattatagcctcacatgagtccaagccagaaatgggttacagggaaggaaggtgcctccatttctatcttgaacagatagcctgctctgggttattctggtgctggttctatgaacggctctcatgtccctactctggcacctcaccccactgggcttcctagtacacaggcttgtgagggtgactggactgtccagtgtatgtctgctgcttgttccactgactctacagaaacaaaacccggtgggtgctagacagtgctggctctgcttgcaagccatgttgctgtggttgttacttatgtgtctggtccaaataaaggcagctgctgatttgttgttaaaaaaaaaaaaaaa

SEQ ID NO: 176 - DNA, 2064 bp, Human
agccctcgcgggggcaaggcggcgaccgaggcgcgtgggtctgggaaggcgcgcggatttggcccctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctg

SEQ ID NO: 177 - DNA, 3027 bp, Rat
gaggcagctggacggcaggagctggtcgtcagttgggctcctttcaggagcaggaccctgtgagctcggtcgaggagtgtgatgaccggggagcagatggcggcctttcacccacccaccactcccaaccccctggaaaggccaattaaggtgggctggctgaagaagcagaggtccatcgtgaaaaactggcagcagcggtactttgtgttgagagctcagcaactctactactacaaggacgaagaggactcaaagccacagggctgcatgtatctgccaggcagtacagtcaaagaaattgccacaaaccccgaagaagctgggaaatttgtctttgaagttattccagcctcaagtgaccagaaccgcattggacaagactcctacgtcctcatggccagctcccaggtagagatggaggagtgggttaagttcctcaggagagttgctggcacgccctctggagcggtgtttggccagcgtctggatgagactgtggcctatgagcagaagtttggccctcacctggtgcccatcttggtggagaagtgcgctgagttcatcctggaacatggtgtgagtgaagagggcatcttccgcctgcccgggcaggacaaccttgtgaagcagctgagagatgctttcgatgcgggggagcggccctcctttgacagggacaccagatgtgcacacggtggcatctctactaaagctctacctccgagacctgccagagcctgtggttccttggagtcagtatgaagggttcctgctctgtgggcagctcatgaacgcagatgaggcaaaggctcagcaggagttggtgaagcagctttctacccttccccgagacaactacaacctcctgagctacatctgcagatttctgcatgaaatccagctgaactgtgccgtcaacaagatgagcgtggacaacctggccactgtgatcggggtgaacctcatcaggtcgaaggttgaagacccagctgtgattatgagagggactcctcagatccaaagagtgatgaccatgatgatcagagaccacgaagtcctcttccccaagtctaaggatgcaccgatctcaccccctgcccagaaaaacgatgccaagaaggctccagtgccgcgaagctctgtggggtgggatgccacggaagacccacccctttctaggacagacagcttcagtaacacagcaagtagtcctgatgccaccagtcccactggaccactgcccagtgaccagcatcaggaagacagcggaaaagcccccagggaaaacccaggagactggaagatgcaatcccgtaaaaggactcaaacgcttcccaaccggaagtgtttcctgacgtccgcattccaaggcaccaccagcagtaaactggaaatctttaaaaatgagttctggtctccatcttcagaggctaaggcaggagaagggcacaggcgaactatgtcccaagacttgcgccacctttccaatgaccagcggacttctacctacgataatgtccccacctcaccacagtcccaagggaacccagcaggtgcactctctccccctgccagtgactccaagagagatgctcttgttagcacagactctgaaatggaggctggaagcaagaactctggcgaggatgaccttgattctctgcagaggacagtccagagcctacagaaggaaatagaaacccagaagcaggtctatgaggaacagattaaaaacctggagaaggaaaattacgatgtctgggctaaggtggtgaggctcaatgaagaactcgagagggagaggaagaaattcgcggccctggaaatcagccttcgaaatgtggagcgctcccgggaggacgttgagaagaggaacagagtcttggaagaagaagtcaaggagtttgtgaagtcgatggagaagcccaagacaaagacggatccttgagggtctgagtggtgtggcagggacagtcaactccactccatttcttcatgctcctagtgagctggaagcagggttacctcctaggatggacagggtatctgagggatgtgccacaatcctcagcaaatacacagaagttgagagtgtacaggagcacaccaggacacttgccaccctgtgctgtgctccaaggattgcgttattccactgtgggaagagtgaactggaatcttccagtgtatgaccaggtccaaaggagacatttaaggtgtgtgacatctcaggaccccaggccagagctgggccaaggcctcagttctttgttgtctctgtggctgtcttgcctagtcagatggttctggtcgctctaaaacatggccagaaaatatttcttcactctccagtgctggccaactgagggctgcttggagaggctgaactgttggaatccaggatcaaacaatatttatgaaagcaaaatgagtgagaaaattatattcaaataaagaaaacagaaaacaaaaattgagcaaggatattggcaatctaatgaaacacttttattagaattagtaaaagggggtttggtaaaattagtaaaagctggctctgtggctgagagcactggctgctctttcagaggactcagcatccacacgatgatggctaacaaacctctgtagctccagttccaggagatctgacaccctctgaggacaccatatatacatatgctgcccatacatatatgcaaacaaacaaacacccgtacacatcaaatacacacacacacacacacatacatacatacatacatacattccaacaacaaagaaaaaaataattagtaaaaggcacctcttgcctgaagcaggtgaatctttcttgtggtacatggctgtgtgaccagggctttgggttccatcctgagtcaccctccagtggacaaaacttgtctgcaaagtctcagagcaaaggtttccaactatgaaatgactttaggggtgtggatttgtatagtgaatagtcaagattattaattattattgtcattgttgttattgctattctacttc

SEQ ID NO: 178 - DNA, 1872 bp, Human
gaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatggtaaggtgcagagaaccttcctgcttccattgggttcttcctttagtccaggccatcccatgtaaggcctgctctcgggtggcaatttggggagttttaggtgatgcagtggcagtgggcgctgctgctacagactcatctgaacacaccttgaaagcctggcctctttccaaatctagtttctattggcatctttgaggggggtgagtgacaagtgtgccaatcacccagtgactgagcaatgaggtcctcactgaagcccactctgaaagagagactcaaatacagtccagagaagttcagtgggaaaaatgtatacaacattgtaaatgttttggtcagaattgttgaaaattctgggtgaacgtccagagaaaactggtttcctgctaacccatgaaacgtgattcctttctcagagtaaaaaaaaaaaaaaaaaaaaaaaaaaaaaa

SEQ ID NO: 179 - DNA, 3322 bp, Rat
aaaaaaaaaagaaaggaaaaaaaaacactccgcacttcttaagagagaagagagaggaagtcaggggacacacaggctgagtggccgtgtggtagttctcctgtctgtgtataaatatttacatgttctgtgtggtctgaatgcagaagctcaaaaagcttgcaaaaaagaaaaaagaaaatgtttctttgttgagccgtgtcttgaaggcaaaagagaaaatgctctactagtctttccttcattgttcttagttgagctctgtgcgtgaatgcttaatttcttttgtttatgacggttttacttaactttaaagacatatttgcacaaaacctttgtttaagatctgcaatattatatatataaatatatatataaaataagagaactctgtatgtgggagagcaggagtatttttgtattagaagaggcctattcaaaaaaaaaaaagttgttttctgaactagaagagaaaaaaaatggcaattttttgagtgccaactccgaaagtgtgtattaccttgtaaagaaaaaaaaaacctacaaagcaggggtttagagctatttatataaatgctgcgattttgcactattttttaatataatatatcagtgcttgtttgatggaaacttctagagagtgtgttgagacttggagaaatgttgagtttaagtctgaacagagcagcaggggtgtgtccctccaccccctgggtctcagagggcccccactgtgcaggaaagccaggctcccccagggccacacagcatgccgcctgcaagccaatggatgcttctgtccagacaggctgtgaacagttacacattccctgccgaaggggacccgtgatgtgtcgtccctctgggttacagctgagtcaggaccgtctcccccgcaccgccccccaacagaggcatccaattccagatgcctttcccaatatgaaaataaactgttaccgaaggaatcttagtttttttttttttcttcctctttaaaacacaaaaactatgaaggttcagtgtttgggggcaaggtgcatccccaaagccaaagcagtccccgaatttggtgccaggtggatacagcagctggcttcatgcagaagcgggttagactccagtgtcccaaggctgggatctacgcagttccaccctggcatgtaggaacggcccagggtgatggctgcttgacctctgaccatgtgtttccctcaatattgattttcacttcaagaagccaattaagagtcagcccaagattgaaagggacaagcccaagtgttcccccaggaagcccaaaggggttaggaaagactgccagcaccagcggcccgtccctccatccctccgcctccagcgtaactttccttctcctcctggactctcccctccgacccggaaagagttgtattagatgtggtcatctgatcatcattatcacacgttagcgggactggggtctcatttcccagcatgtaattagtatgtaggatgctgggacccctagagggcttgctgttgtgtcttctgtgaatacaagagaaagcggggtgagtgtgtagtgagatctcttagggttcagcagcagcagaggtatcaggagcagaggtgagtctgctggaatccctggagtgaccccgccacccctccccatccacagggcggtcctatttcctgccgaaaacgttatcatgtaaatgagagacggtaacctggacacagcacctttttattacttgaaaaccttttggaggtcaggccaccatgcctgcttatacacatacagtttttaaaatataggttaccctgctaccctgctggatcctgagcctggaggcctgcagatccatccgggcagaacattcccaggagacctacttctccaggagtggttgacctgacctctcaaagaggattcttgaaaatatcacgatgtcactgagatgtcccgtgtttccctgtgcgaataatatccgatgccttaccgaggaagagctctccctccgggctcagggtggggacactccctacagtgtctcactcttggggccagtccatcaagggctactgctgaagttcaactgtgcacacccctccccttcccttcccttccctcagcatgcatgtaccctgcttgcagaggcccccagctgtccctgcagcctcatggaatactgcatgtggctcccattcctctagacaaggaaaccttatttgtgtctgcggcttcagctgaaagccaagccaaatgaacgtgcccactgtcctctggggccaaaatggctgtccttgctttgttggatgggttgttgcaggggcttgctgggctcatttgacttaagggcacacctactcctttgggtaacaaccctggactagaaactggggtcccttggatgtgggttgtaggagcttgaaggaaaggacttgtcaaaggcagggtgtcctgagtgtcaggctgtcagtccctgcaggctgctggtagtgggaccctgagctctggccaaactctacatgctgggtccacactatctcttcccatggcaaattaagcagatcctgggaagtggctggttggaaaggaaccgacctggtaggttgggggggggggcagagatggggagtctattgctcctttcggttctgagaaagggagagttcttgactccctctgcccacattaccatctccactgcttgctccagagaggtcacagcccctgcagagctccaggctgtgtaaaggcaggaaggctctgccgagctccaggctgtgagccagctttgtaaagctgggatctgcatgactttgcctactgcgcgaaagaagtctgttgttttagcaaaaagttaaaatgtgaccctgtaccctacgtgtaacaggaatcagggtcaggcagactccagaccctctctgttcaaccgctctctgttcttggtcactgttgtgacccgcgtggccaagttccatgtccctcaacttccagaaccacagaatattgtaatgatgcgagatgtgttctcatctgtgctctggacttgagagcccgaaatgccacacctcctttgtcatctgtcacccctccctcagcaccctgtccggctgcactgctgctcggctttggggtgcccttctttgcagctgtccccccaccttctgttcctggtcagcacttgggatttctccgtgcctggagcacccgactgtgggagactgtacccaggcctgaagaagctgttctctgtgtatctatactctttggtgccaatgttggcgttctgaaaagccgcaatacacaataaattttacagttctttgg

SEQ ID NO: 180 - DNA, 4839 bp, Human
ggaaagctagcggcagaggctcagccccggcggcagcgcgcgccccgctgccagcccattttccggacgccacccgcgggcactgccgacgcccccggggctgccgaggggaggccgggggggcgcagcggagcgcggtcccgcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttgg

SEQ ID NO: 181 - DNA, 2109 bp, Rat
catggacctgatgtcagcgctgagcctgggcgagctagcgctcagcttctcgcgggtgccgctcttccctgttttcgacctcagctacttcatcgtctccatcatctacctgaagtatgagccaggagctgtggagctgtcccggcgccaccctgtggcgtcctggctgtgtgccatgttgcactgttttgggagttacatcctggccgacctgcttcttggggagcccatcattgactacttcagcaacagctccagtatcctgctggcctctggagtgtggtacttgattttcttctgtcccttggacctcttctacaagtgtgtctgctttctgcccgtaaaactcatctttgtggctatgaaggaggtggtgagggtccgaaagatcgctgtgggcatccatcacgcacaccaccactaccaccacgggtggttcatcatgatcgccaccgggtgggtcaaagggtctggtgttgccctcctgtccaacgtggaacagttgcttcgaggtgtctggaagccagaaactaatgagatcctgcacatgtccttccccaccaaggccagtctgtatggagccatcctgttcaccttgcagcagactcgctggctcccagtgtccaaggccagcctcattttcgtcttcaccatgtttatggtgtcatgtaaggtgttcctgacagccacacactcccacagttctccatttgatatcctggagggttacatctgcccagtgctgtttggggcaacttggggaggcgaccatcaccatgacaaccatggagcaccacatggcatgggactaggcacccagcactccggcctgcctgccaaggccaaggaagagctgggcgaaggatccaggaagaagaagaccaagaaagcggattaggggttggccccaggaatccactgcgtgcttggtagaaggatgtggactcaaagaaactcagaacttaggggcattcagggctcagaccctcccctccccccgccctgctctctaccaccctcaacttccccatctgcagtttggagccatcagcaattccaagggctgatgtgggctaaattagtgtggaggaattcaacagatgtggaaaaccctgccctctgccagacccctcaaaaggtcacagcctttgggggcacacagtctaggcccaaagccctggctggtaggctcttggttttcattctgtgttctgtctaattatatcttgtaactaaaagaatttaaagccacatggagactcaattatctagatcctctcgagagccaggtgctggggtcccatgtccttccgcactcaggacctccctagaattttgtgactcctgctggacatctttaggcaaatggccttccttctctgagccttctgtttctgttctgtagcatggagaccccaggtcctcctgtgtacaaaagggtctttataatttcaagcagttgcttaagcagcgtgctagtgagaaggagactggagcagcatgaaggacagtggcaggctgcttggtatgtaggccatttgtgtttgaggccagaaggtctcaccagatactcagctgagcatgagcaggcacatttagggcagactgctaacaggaggggggcttgagttcctaggtgcccacaggtaagaggtgtgggtgcagagcagagggtccaagagccaacagccttggttcctcacaattgggctctgggtgtatcaggtgtccctcatgcctgatcagcatagttcattcagtcattcaacaaacacacagatccacacatgctcgctatacagtgtcatgctgctcctcttaggagcgagccttatacaggggaagggccatggtcgccaaagtctccagggcacctgagagaggtgagcatggggtcctgctggtctcaggcttatgtgaggctcagatctagttgaagtacccagtgtagcccatttgttgagaaaatgctactcataactttgcctggaggtagggtaggccctgaggctggaagctcccgagtttcatccccttgatgtcagtcaaagctcagtgtgagtgatcagccaataaatctggtgcgagtaaatcaaaaaaaaaaaaaaa

SEQ ID NO: 182 - DNA, 1639 bp, Human
agctgcgggggcgcagtcgccgggccgcgggcggcgggacggacgaggccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggttctggtgtcgccctcatgtccaactttgagcagctgctccgaggggtctggaagccagagaccaacgagatcctgcacatgtctttccccaccaaggccagcctgtatggagccatcctcttcaccctccagcagacccgctggctcccagtgtccaaagccagcctcatcttcatcttcaccttgttcatggtgtcctgtaaggtgtttctgacagccacccactcacacagctccccctttgatgccctggagggctacatctgccccgtgctgtttggttcggcctgcgggggtgaccatcaccacgacaaccatggtgggtcccacagcggtggtgggccaggagctcagcattcggccatgcccgccaagtccaaggaggagttgagcgagggctccaggaagaagaaggccaagaaggcggattagggggtggcccaaggggcaccggggagaggacccggacccaggaccctctgagctgggaggcttcctgcgctcagacctatcctttcctggccttgacttccccatctgcaaatcagggtcattggctcaccctccagggctgacgtgggggttgagatatggggatgaggatgaagaacttttgtagaaatcggggttccctctttctctctgccaggaccccatagagtcacagcttttggaggggttcacagaatcctggcagcagctccagtcaagaatgtcactggttggcatgatattcttagttctatttttccttctttaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctcaaaaaaaaaaaaaaaa

SEQ ID NO: 183 - DNA, 3466 bp, Rat
ccttgaccacgtactagcgttctgtccctccatacattactgagcaatgtgtgtctgtgggactctgcatccagcgctggaccatgaccccctgtgctgccagactcgcgcccgagaccttctcgaggcccgccggccactggcccatgagtgcctgggtgaagctctgcgagtcatgcgccaggtcatctccagatacccactcctcaacaccgtggagacactcacagccgctggtacactcattgccaaggtcaaagcctttcattatgaatgcaacaatgaatcagataagagggaatttgagaaggctctggaaaccattgcggtgtccttcagctgcactgtgtccgagttccttttgggtgaagtggacagcagtactctcctggcggtgcctccgggggaccccagccagtccatggagaacctttatggggctggcacggaggggcccccacataacgtggaggaatgtgaagaaggttgcctgccccccgaagaggtggacatgcttctgcagcgatgcgaagggggtgtggacgctgcactgcagtatgcaaaagacatggccaggtacatgaaggacctcatcagctacctggagaagaggaccaccctggagatggaattcgccaaaggtctccagaaggttgtccacaactgcagacagagcgtcacacacgagccccacatgcctctcttgtccatctactcactggccctggaacaagatttggagtttggccacggcatggtgcaggcagcgggcacactgcagacccagaccttcatgcagcccctgacgctgcggcggttggagcatgagaggcgcaggaaggagatcaaagaatcttggcatcgagcacagaggaagctgcaagaggcagaggccaacctgcgcaaggccaaacagggctacaaacaacgctgtgaagaccacgacaaggcccggctccaggtggccaaggctgaggaggaacaacagggcacaggcccaggcgcagggactgcggcctctaaggccctggacaagaggcgcagactggaggaagaggccaaaaacaaggccgaggaggccatggccacttaccgcacatgcgtggcagacgcaaagacacagaagcaggagctggaggacacaaaggtgactgcgctgcggcagattcaggaggtcatcaggcagagtgatcagaccattaagtcggccaccatctcctactaccagctgatgcacatgcagacagcaccgctgcccgtgaacttccagatgctgtgcgagagcagcaaactatatgacccgggccaacagtacgcatctcacgtgcgtcagctgcagagaggcgaggagccggacgtgcgctacgactttgagccttatgtctctaacaactcctggtccccaatcatgcgtacacggaagggcagcttcaaccctggtgatgcttcaggacccgaagctgctggtagtccccccgaggaaggtggcacctctgaggcagcacccaacaaggaccacagggggggacgaggtcaccaggttcataagtcctggcccatctccatctcagacaccgaagttggtctggacaccagctcaggggacttgaagaagttcgatcgaacatcttccagtgggacgatgtcatccagtgaggagctgggggatcaggaagctggcttggtagcttccgcctttgattcagctgacctcaatggcatggaccccgagttacctgtggccatgcccagtggacccttccgccatgtgggattgtccaaggcagcccgcacacaccgacttcgcaaactgcgcacgccagccaagtgcagagagtgtaacagctatgtgtacttccaaggagctgaatgtgaagagtgctgtctggcttgtcacaaaaagtgtttggagaccctggccatccagtgtggccacaagaagcttcagggccgcctgcagctctttggacaagacttcagccaggcagccctcagcacccctgatggggtgcccttcattgtcaaaaaatgtgtctgtgagattgagcggcgggcactgcacaccaaggggatctaccgggtcaatggcgtgaaaacgcgtgtggagaagctgtgccaggcttttgagaatggcaaagagttggtggagttgtcacaggcctcaccccacgacatcagcaacgtcctaaagctatacctgcggcagctaccggagccccttatctcttttcgcttctaccatgagctggtgggactagctaaggacagcctaaaggccgaagccgaagctaaggcagcgagccggggtcggcagggtgggtccgagagtgaggctgcaaccttggctatggtgggccgcctgcgtgagctcatgcaggatctgccagccgaaaaccgggccacactcttatacctgctgaagcacttgcgaaggatcgtggaaatggagcaggataacaagatgacccctgggaacctgggcatcgttttcgggcccacactgttgcggcctcgacccactgacgccaccgtgtccctctcttctctggtggattatccccaccaggcccgagttattgagactctgattgtccactacggcctggtctttgaggaggagccagaggaggcgcctggcagccaggagggggcatccacccagtgtggccagctggagtctgctgagggcattgtcttccccctgcaggaggaggcagaggacggaagccgagaatctcacgcggcatctaatgactcggactctgagctggaagacgcttctgaccccctttcatcctcggacgccagtgctctacaccgcctcagtttcctggagcagaccgaggcaggcctggaggaaggtccccagagccatagtggcagtgaggaacagctggagggtgaggatggagccccgggtccgtggctgtgtcacttcaacaccaaccagtccaacaacacatcacgggcccctctgcccaccatgcggctccgaggagggcagatcacaggtggcaccagtcaggagcggcagccacagttcgtctgagctgggtggtgatggcagggaccatcagctcaatgtcagcctttgactcggggggaggggggtgttcctcacaatgccgaggaacttcagggagatcagggctccctggtaccatggacacagatggataacagtcccagatggagttgcctggcctttgtgtgcctgtggggatgcagctgcagattcccatgatggcctcatctctcccatggtccccatcagtctggatgtgtctgagcgggtacagccctgacctctgtgtgtggagctggaggtggctctggcttcaggaatcttgcaggaggctggacatggacagacgggtgggggcacacagtgggtctctcccaaggagcagtaaaggagctttccacatgaactcacaattttcttgaaataaacttcttaaccaac

SEQ ID NO: 184 - DNA, 4080 bp, Human
ccacgcgtccgcccctaccgggcgggacggcaggggccacagcagagaggccgggaccccggcattcagctcacggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggatgactgtgacgccggctgcctgcccgccgaggaggtggacgtgctgctacagcgcagtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcagagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggcccgaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcagggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagccgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggaaaaaaaaaaaaaaaaaaaaaaaaaaaaaaaaaaaaaaaaaaaaaaaaaaaaaaaaaaaaaa

SEQ ID NO: 185 - DNA, 2328 bp, Rat
cgcagccggggcccgaggagggccagccccagcccgggcgagcgcacgagtgggtacggccgcgcgggtagcgccctgagcctgtcccgcgccgccgcccggccgacagcacagcgcccggggatgccccggcggcccggagcacgctgaggctgcggaaagcgcgactgccaggaactgttgctgctgccgccaccaacccccatggcctacattccggatgggggtgctcctaccgctggggccatccccttgggttctcagtgctgtgtgtgcaaagtggagctgtcagtgagtggccagaacctgctggaccgggatgtcacctccaagtctgaccctttctgtgtcctctttatagaagacaatggcaggtggatggagttcgacagaacagaaacagccgtcaacaacctcaacccagccttctccaagaagttcgtgctggactaccacttcgaggaggtgcagaagctcaagttcgccctgtttgaccaggacaagtccagtgcccagttggatgagcatgatttcctgggccagttctcctgcagcctgggcacgattgtctccagcaagaagatcactaggcctctgctgctgatgaatgacaagccagcggggaagggcgtaatcacgattgcagcccaagagctgtcagacaaccgagtcatcacactgagcctggctggcaggaaactggataagaaggacctctttgggaagtcagacccttttcttgagttttacaagccaggagatgatggcaaatggatgctggtccataggaccgaggtgattaagtacaccctggacccggtgtggaaaccattcactgtcccgttggtgtccttgtgtgatggcgacctggagaagcccatccaggttatgtgctacgactatgacagtaatggaggccatgacttcatcggcgagttccagacctctgtgctgcagatgagcgaggctcgggatggtgtcccgctggagatagagtgcatcaaccccaagaagcagaggaagaagaaaagctacaagaactcgggcatcattattctgagatcatgcaagatacaccgaaactactcattcctggactacattctgggaggctgccagctcatgttcaccgttggaatagacttcacagcctccaatgggaatcccctcgacccttcttctctccattatatcaaccccatgggcaccaatgaatacttgtcagccatctgggcagtgggacagatcattcaggactacgacagtgataagatgttccctgctctgggatttggggcccagttaccaccagactggaaggtgtcccatgagttcgctatcaacttcaaccccactaaccctttctgctcaggcgtggatggcatcgcccaggcgtactcagcctgtctgccccacattcgcttctatggccccacaaacttctccccgatcgtcaaccatgtggcccggtttgcagcccaggccacccagcagcagacagcaacgcagtacttcatcctcctcatcatcaccgacggggtcatcagtgacatggaggagactcggcacgccgtggtgcaggcctccaagctgcccatgtccatcatcatcgtgggtgtgggcaatgctgactttgcagccatggagtttctagacggggacaaccgtcgactgcgctcacacacaggcgaggaggcggcccgagatatcgtgcagttcgtgcccttccgagagttccgcaacgcagcaaaagaaacgctggctaaagcggtgttggcggagctgcctcagcaagtagtgcagtatttcaagcataaaaacctgccccccaccaactcagagcctgcctgagcccatgcccagccgcagcatgccagctgagcccccggcctccccaggaacatgcacgttcaccccgcttcctcgtgggtggctttttttttttttttaaaaccagtccacgttttcattttttacaactggacctccacccacaacttccccagcccagctgggctccctttgtcagagtcaatggatgatgcttccaggacaaatcggcttcctctccccaccctcctgccactctaagtattgaatgtactttgtataattttagtggaattattgttattaaagagaataaaatttttacaatcataactggctttttctaagtaactagctgcaagaaggaatgtatatcccttactgcatactttgtatggtggtctgctgtttttatacttgtgactgtgttctatttgtaaaactcagggtaataaaggagtttcagatgttgaaaaaaaaaaaaaaaaaaaaaaaaaa

SEQ ID NO: 186 - DNA, 2197 bp, Rat
ccgggaggaggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaatttttacaatcaaaaaaaaaaaaaaaaaa

SEQ ID NO: 187 - DNA, 2211 bp, Rat
cagggatcccacccccacagtttcctggctttcctccaccagtacctccagggacaccgatgattcctgtaccaatgagtattatggctcctgctccaactgtcctagtacctaccgtgtccatggttggaaagcatttgggagccagaaaggatcatccaggcttaaaattaaaagaaaatgatgaaaattgtggccctactactacagtttttgttgggaacatttctgagaaggcttcagacatgcttatacgacagctcttagctaaatgtggtttggtgttgagctggaagagagtgcaaggtgcttctgggaaacttcaagcttttggattttgtgagtataaagagcctgaatctaccctccgtgctctcagattattgcatgaccttcagattggagagaagaagctacttgttaaagttgatgccaagacaaaggcacagttggatgaatggaaagcaaagaagaaagctaatgggaacgccagaccagaaactgtcactaatgatgatgaagaagccttagatgaagaaacaaagcgaagagaccagatgattaaaggggccattgaagttttaatccgagaatattccagtgaactaaatgccccctcacaggagtctgactctcaccccagaaagaagaaaaaggaaaagaaggaggacattttccgtagatttccagtggccccattgatcccttacccactcatcaccaaggaggatataaatgctattgaaatggaagaagacaaaagagatttgatatcccgagagatcagcaaattcagagatacacacaaggtagtattcttgatttttcacttgataccaatctagactttttacagaatccaaagcaaaaagacaagaaaatcaactttgcattagagtataatttattattgcctttaataggcttaattgatactaaggtagaaacaaaagaacagaagactaataccatatttaatagtggccattgctaattgttctcagtcactgactgctgcaagcatctcactttaatataacaaaagttaatttagatttcaacatgaacatcaaggtcagattaaactattcagggggcagcaggataacatacatatagttcagtttatcttgtgggcaggtctttaatcctaggaaaaacttttttaaagagctgagattaaaatttaagatttatatttgtgtggattaagtttgagtgggggagattttaaaacgtaggccagtgattaccagacttaccaaattatagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtgtttgtatatagtaaatcccactcatgagttttgcctatttaaagcttctctcaatgacagtgcatctgtgaatgttcgctggtattgaaggtgatgctttcggatggtgaaatgcaaagtgcatgatgtattttgatgttagaggtaataagatatcattggttctgactagactgagaagtgcataacataactcagtggtgttaagtgttcactttctctgtatttgaatcatattttttcttactgctttcaaaatcccaagttacaattaatgctgattatcagtgctgttgaacacttaatgtccagatacccaatcataggtcacatagagtgctttttcaggaagtagatgtgtctaaaagcacaaatgtaactcccacagttttgagagttacaatggtggtctgtggcaagtcatagtagaataatcttaatgtatgttcactattccaattaaaggctgagtaagctttcaaagggtatacagttgtgtgtgtggtttacccgccttctgtttttatttatttgttttaatccctgtcatgttattggtgaattatgaggaaatcaggttggtaaaaatttttaattcacaagctactacttcagcattttaggggtttgtcaggcatttcactgccttttattttactgatggcaatgttctgaatttccaaaatgtgatttagaaaaaaaaaaaaaaaaaaaaaaaaaaaaaaa

SEQ ID NO: 188 - DNA, 6868 bp, Human
atcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaaacagttgttttttattgggtggtttggctaaaagggttgtttgaaactccagtaacaaaaaatgagctcagtgaacctttgcatgttttggtatgagtttattaaataaccacagactgtcagggtatcagcgtggcagggggcgtccatttacagcacggatgagtctgaagagagaataaggtaagatttatgattttttaatctgtcctttcctcttcatgactttcttacataattttagactcacctcatttcccttctccagtctttctttaaaaatatacatgtatatgtttacatgtatacctgtatttgtatacatgtgtgtatatatatatatatatatatatctcatatataaacttcaggaaacatttagtatggactagattcactcactttttcatttacttagaaccaaacttttgaaatgagttctgaaacaaatggttatttatataactgaatataaggagcacagtgaaataagcaagaattaaaaattgaggaattctacaggaaaaattagtattggaacagctaaaatattctgtaagtatctatttcagaaataaacaaatttctttataagtgtatgccattgaggtaagttttatatagtctagcctcattttacaatataaatttttatattcattggaactgtttcagaaatgagatttttccccctttaatagctgttagtttctgtcctctttctatcatatcttatttcatccctttgtaatttcaatgtattcagttttgactttgcccgtattctacttcgatatagactggcacagcaactgaatatattgctcatacattagctttcctttcataacctgctataagttctctgatccatgaggaagagaaaaagagtatctgacaggtaagattgctttttaaagttgttttaaatgcattacatgactgagaaaagaaaaatgcacattttattgttgcagtttaaaatttcattttggtgaaactaaacgtgaaacaaaagggataaatgtgttttgttttgttttgttttacctgtttggggtatttttttctgagtttgtgtagaaaccgtgtggtacactggtaatcttgtcagggtacaaacttggtctgactttgttatttggtttatttgtgaaccatgtacttgctcttcctcccagaaacatagcttgtaggcaaggttaatccagtgttggcgatccatgtcctagcacagcatctgtaagttaatgcacaatcgttccttccaaggatggatttatcattgtaaatatattttcattgtcttacaggcataatgggcataagtatgttgcttttaaatattttaaattaaactattacagttacatatattttgcttgaagtgagtgattttcaaactttttgtatttggtgggctgtccatcttgtaatggtgggagtaaatgttttcatagatgataaggcagttcttggctgaattcagcttgtgtttcttttggagggtgggcaaatcagagggcagagattatttagttgcattataggtattcttctataccacttgccctttgaaaccctcaacttgaggtaatgtgcagtctggggttttaattagtattaataatcttgtggatttacagaaatctataatgcacagagttgagttttaaccaatgatcgtattcatagaaaatatttcgaaccaccacattcttcatggtcattttagttagtacatagtcattgagtggccagccacacctgacacaatctcccagcatccaagattggagattcctggtctgtgtagagtatatggttttgcacgaaatctttctagtcttgtgattgcttcagtttaatttgtcacataaaaccacaagtatttaatattaatgtatcagtggtttggtgttttgttcccagtactgggctttgcgccgggaaaaatctgaatactggagctacagagttaactctaaaagtgcttttattggtttctagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtacgttagcatttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagttaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgattcgtttcttgtaaatattaaaacgactccccaattaaaaaaaaaaaaaaaaa

SEQ ID NO: 189 - DNA, 992 bp, Rat
aagtccccggggcgtcccggggaaacttggacgtattgccttgggctctcagcagatgatcctctaggcaccgcagcccgcagctctggcagatgagaccatgacccacgtgttggcaggaggccagagacaagaggacccagagaggtttggctaccatcgaacacacagccagccagggctgagatggcaattcaccctgaccctgctcttcactgcctcttggtaaccctgtgctccctcaaaccccgcctcttcccgcttcttccgttcttgctgtggactctcctgagctgtgatttgaggggtgctgcccagggtccgggagagtggacgccctgggggtcttggagcaggtgttccagctcttgtggtcggggcgtctcagtgcgcagacgccaatgtgtccgacttcccggagaggaactttgttggggcgacagccatgaataccgggtgtgccagctgccggactgccctccagggaccacaccattccgagacctgcagtgttctctctacaatggccaccctgtcctggacacccagaaaacctaccagtgggtgcccttccacggggcgcccaatgtgtgtgacctcaactgcctagctgaaggccacgccttctaccacagctttggccgcgtgctggatggcaccccctgcaccccgggtacccagggtctctgcgtggcaggccgctgtctgagcgcaggctgtgacgggatactgggctccggcaccctcgaggaccgctgcggcctctgtggtggcgctaacgactcttgcctgttcgtgcagcgcgtgttccgcgacgccggtgactgtcccattctgactcaccaccagcgcttgagaaacacagtggagaggggtgtccctttaacaagtttggctcctgggagccaaggctcttgttgattgggcttcccctgattggcctctgacagagcgtcccaccctccctcgaatagatgcgcttttaacccccc

SEQ ID NO: 190 - DNA, 1513 bp, Human
cgctcgcgtccgccgggcagtcccctgccgcagatccgcgcccgccgcgcgagggcgcccggggccgccgcccctcctgacccgggcctgggcgcgcctgcggaggccgcggtgggagggaccgtcccaggctccccaccccgcccagcaccttgggccccgccgcttccgctcgccctggggccgctcagggagccgggacgcgctgcctgggctccgcgcagccgatgacattctgagttcttcctctccataccgggctccacgtctcctgtcttctttacctgatccacaggacccctcaactttcctgtaagggaggctctattaccccgtttttcagagacgagaggtagggctcagagaggtttagttactttccaagatcacacagccagtcagggcagagccgggacacaaccctgtgtctctggcggtggctctatggactcggcccctctgttccccaggccccacctcttccagaacctcctgctcttcctgtgggccctgctgaactgtggtttgggggtcagtgctcagggtccgggcgagtggaccccgtgggtgtcctggacccgctgctccagctcctgcgggcgtggcgtctccgtgcgcagccggcgctgcctccggcttcctggggaagaaccgtgctggggagactcccatgagtaccgcctctgccagttgccagactgccccccaggggctgtgcccttccgagacctacagtgtgccctgtacaatggccgccctgtcctgggcacccagaagacctaccagtgggtgcccttccatggggcgcccaaccagtgcgacctcaactgcctggctgaggggcacgccttctaccacagcttcggccgcgtcctggacggcaccgcctgcagcccgggtgcccagggggtctgcgtggctggccgctgccttagcgccggctgtgatgggttgttgggctcgggtgccctcgaggaccgctgtggccgctgcggaggcgccaacgactcgtgccttttcgtgcagcgcgtgtttcgtgacgccggtgccttcgctgggtactggaacgtgaccctgatccccgagggcgccagacacatccgcgtggaacacaggagccgcaaccacctggcactgatggggggcgatgggcgctacgtgcttaatgggcactgggtggtcagcccaccagggacctacgaggcggccggcacgcatgtggtctacacccgagacacagggccccaggagacattgcaagcagccgggcccacctcccatgacctgctcctacaggtcctcctgcaggagcccaaccctggcatcgagtttgagttctggctccctcgggagcgctacagccccttccaggctcgtgtgcaggccctgggctggcccctgaggcagcctcagccccggggggtggagcctcagccccccgcagcccctgctgtcacccctgcacagaccccaacgctggccccagacccctgcccaccctgccctgacaccc

SEQ ID NO: 191 - DNA, 263 bp, Rat
cattccattcctatggtacgatttgcttgtaatgttaatcattgactatagttctgctacttggatgccgatagtgaagcagagaacaattaatcatcattgattatgtcactatgcacgcgactttgctaaacatgacgaaatgtattaaacatttgtccaactatttatgaaatactttacataatttaatttgcttttgtacagttttctgtaaataaattgcttgtcatttttttctttacaaattaaaatataacatg

SEQ ID NO: 192 - DNA, 2388 bp, Human
agcggaatgtttgcaagctggttaaggcatagccttgatggctctctagcaaactgtagaaacaatgtagctttgggtagtttcatgctttgcagaatttcttagactataaagtgacacagcctggaatataggttgataattcactataggtcttcaaaatacttatctttgaaaaccgcttctctgtttggtggggtacaatttgggggtcatttccttatgctctttcttaaatggagttttcattttgatgttagtttatgtataataggtaggatgcaaaaagatatgtaattgaaacaaaaaacattggactaaaatatcagtaattgaacatgtttatgtttgattattatttacactatggaaagatgcaattctagtactttgttaggaaactgcattaaagcagttctgccttgtataatctgtaagtacctattaagacaaaatacttctaaagatacttatgaaatgtatacacattttttcttgcacgttacaaagaaaatactcaattgcataacacggatgtttgacaaactttttttttttttaatgcatttctttctttcatgagacattgaaaccactgatagctcatttcaccctatcttaaacccttctcttgtctataaaactaatacgggtcacaccggaccttcggattaattggatccacattccccaatgatgtttgcaccccattcaagatagccatgccattgtcatttaactcgtgaacctctctttaaaactaaaatggatgtgaaagaataaaattcagtgtactgtaagtattcacagtaattctagtagaattagctgtcataacatgtttattatataatgagctggcatgacacagaaatatattttgtgtttgtatgacttttattttaaataggttaaatctggtgccactccatatatagagtgcttttgaaaaaaaatcaataaaaagaaacaaaaaaaataaatgagtgaatgcaaaataagcaactgtgccttttatacctgttgttacggtaaaaaaacggttgttgggtttggacaatgaggggaaatgggctattcccaacttttttgatcatgtatatttgtccatgtttattttctgaacataataaataatatattaaaaatttgccttctgacaaactcagataatggaccagtcttaaatattgttatgtcataaagcaaagttaaggcattaatatgggctgcttaaatctgactagaagatgaaagcgtttattgtaagtgtaacacagagatactatcaggagtgaaatcagtccatttggcaaggtaaaatactgatttagagttttattctttatttcttttttgttgcgtttctttcagctatggtttcattttggttgtacagtatataaaccatatttgttttctgtacacaagactctcaagtgaattttgcatgcattatacattaggacacatttataaattaatgagtaactatataaatttatgtgtattaaaacgtctgtagcttcaatctaaaatctactgctctttctgaatctccagatatcatttctgtatggtttctgactggcctgctgcctgagtttcagaaaacaagggaggcattatttttatgggaggaggaactaagatggtactgaggatgtctgactgaaacactaccctaggaagctgtcttgtaggaaaatagaataaaacacacagaccagaagaaattgtcaagaagcaaacagccatccaaaaacagtcatgagaaatctaaagacctaaataatcttaggtatatgctctcagtgagaaataagaaaatgtgtccttaagcaaaaataaataaataaataaataaataaataaataataaaaagtgagcatgatcatgaatatagtaaatcttgtgagttgtgacctaggtgaaggtgtaatgataacatctggaggaagcatcatttgttcagctacctagggtttactttcagacttttcctacagtttaaagcacttgcgttcagtgtggtacgatctgtttgtaatgttaatcattgactattgttctgctacttggatgttgatagtgaagcagagaacaatttatcatcgtttattatgagtcactatgcacgcaactatgcttaacatggcgaaatgtattaaacactcgtccaactatttatgaaatactttgcataatttaatttgcttttgtacagttttatgtaaataaattgcttgtcatttttgtctctgcaaattaaaaaataacatggtcaaatggttaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaa

SEQ ID NO: 193 - DNA, 1239 bp, Rat
acccttccggaagggtaggaacttccggaaaccaatttcgtggcgggaagaactgctgggttattttctgtggcgttcaaacctgcgggcctttgcaatggaggagcagccgcgggagaggtctgaggccggggctgaggcctgcgaagagaagcggggtctgtcgcaggccgcggaggagcgtatcgaggaccgtatcagcctgctgctcaggctgagagctcagacaaaacagcagctcttagaatataagtccatgatcgacacaaatgaagaaaaaactccagaacagattatgcaagaaaaacagatcgaagttaaaattgaagagctggagaatgaaattgaagatgtaaaaagtaatattgaaatgaaaagtcttgcactgagcaggatgaaactttcagttgcacttcgggataacatggagaacatgggacctgagaattgtgtgctcacagatgacatgaagcacatattaaagctacaaaagttaataatgaagtcccaggaggagtcttcagaactggagaaaaagctgcttgatgtcagaaagaagagactacaactaaagcaagcttcaagaagtaagcttttagaaatacaaatcgagaagaacaaacagaaagaggatgttgacaagatggagaattctgaaatgataaagaccatgaaaaaaaaactacagacggagataaagatcactacagttgttcaacatacattccagggccttattttggcgagtaaaaccaactgggcagaggaccctgccctcagagagacagtgctgcagctggagaaggacctcaacacgctatgagaagaatcccgcagtttaaaattggctttgtgaccaatctgtcatttaaatagccgagttcatgggaaatgtaaatggtgtttttggaaccactctgctgcttcagttttggggttttgagttgatgtgacacagaacctttcgttttaattgtgctcattaaagtggcatcctctgcaggagtctggccgtggaggccttggaaagaagcgggcggtcctgctgccaccggatgtgcatctccttgccaacgtttccccgtgaccccttttggaatatgcttatgcatctgcacgctgtgcaaagttgtgtgtgttaagtaaggttgtgtcttcttttctccttctctacttagcatgcattttacttttataacttaaggaataaaaagaataaacattactgcattattaact

SEQ ID NO: 194 - DNA, 1405 bp, Rat
tttcccggcgtccatttagtggcgggaaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgttaaaaaaaaaaaaaaaaa

SEQ ID NO: 195 - DNA, 2695 bp, Rat
cagtgatggccggcagacagactggttggagccaggcggctcttctccagttccttcttggcatgtgcctaacggtgatgccacccatacaggcccggagtctacgctttgttaccttgctgtatcgacatggagatcggtcaccagtgaagacatatcccaaggacccctatcaggaagagaaatggccccagggatttggtcagctaaccaaggaagggatgctacagcactgggagctgggccaggccctgcggcaacgctaccatggctttctgaacacctcttaccacaggcaagaggtttatgtgcgaagcacagacttcgatcgtactctcatgagtgctgaggccaacctggctggactcttccctcccaatgaagttcagcacttcaaccctaacatttcatggcagcctatccctgttcacactgtgcccatcactgaagacaggttgctgaagtttcctttgggtccatgtccccgttatgagcagctgcagaatgagactcggcagacaccagagtatcagaacagaagtattcagaatgcacaatttctgaacatggtggccaacgagacagggcttacaaacgtgaccctagagaccatctggaatgtgtatgacacactcttttgtgagcaaacccatgggctgcttctgccgccctgggcctcaccccaaaccgtgcagcgtctgagccagctaaaggacttcagcttcctcttcctcttcgggatccacgagcaagtacagaaggcccggcttcaggggggagttctgctggctcagatattgaagaacctgaccctaatggcaactacctctcaattccctaagcttctggtttattccgcgcatgacactaccctggttgctctgcaaatggcattgaatgtctacaatgggaagcaagctccctatgcttcctgccacatatttgaactgtaccaggaagataatgggaatttctcagtcgagatgtactttcggaatgacagtaagaaggcaccctggcctctgatcctgcctggctgtcctcaccgttgcccactgcaggatttccttcgcctcacagagcctgtcatacccaaggactggcagaaggagtgccagctagcaaatgatactgcagacacagaggtaattgtggcattggctgtctgtggctccatcctcttccttctcatagtgttgctcctcaccatcctcttccggatgcaggcccagcctcctggctaccaccatgttgcagacagggaagaccatgcttgacaaccactcagtccccttccctctgcctcctaggggaggtgggctgagtcctcgctcctgaccattgctgatcccagcccagggacagggttagccttcctgattacctacgcccaaatgaatgagtgaggctcggctgggtgtgcggcacctggggctcaccatcttcatgcctgatgtttaccgtgtactgtgttggacactggctttctctaaatgggatttgcctcttctatattccctaaggacttgagatgcagacaagcattcagatttcactcaagacctgggactaaaaaacaaaacaacaaaacccccatgaaaacctgaagaagctggtacttgatctgccttgctcttccaccgagccttgctctttatcttctagcccatatctttggcaaatggcttggaggacattgtcccttggtacttttttagaggcaaaaactgcaaatcactaggagtataaaatatggctatcaagaactcgggtcatccaacagcaaagtcatcctttggctgaggctaccgtcagtgtcaaccacaggcaggtctgaaggatacttgggctgtacctggatgacagtgggaggacacaggtaggagtgaaacacatggaatcatgaggtgactctcctcagctgggctggactcttcagggaccgtacaccttgaccgtggccccaaatagggctgaagtagctccgaggaaatgaaggttttgactgtgagtgctggttctgtgccttttttcccttccccatttctgacatccaagaagcactcttaccaggtcagtactagatctactcagaaaccctgttgggcttttgggtttttagttagatacaaaggatatgcttttattggccatgctaaaattgaacataaaagttttaaaattctctggttattttgctcctatacatcagaaaaaagaaaagtaccttggctctagcataaacttggcctccaggctagatatagctgggaccctgagcgtagctggtttactctttaattttctggagcaaaatctagagcagtaacatgtcagcatcctagtcccacagtatcccttgtcacaagtgtccctgctccaaccctaagaattgggtacttttggcctattaacaaacagctgccactcctcacagaatgtgttcccatctgtggggtccagtattgctgtcccacaccatcttcatagtctttcatgatctttctgtgacccatcttcctcttggctccaaatgagaatatgataacctagaagaaacaagaagtctgaatgacaccttctgttgctggtctgtctcagaggttggggctgtcttggggaactaacagactgacattgccatgactaaaataaaaccagatgggtgacctaggccagaaaaaaaaaaaaaaaa

SEQ ID NO: 196 - DNA, 2109 bp, Rat
ttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 197 - DNA, 1565 bp, Rat
cggaacttcagaactgcggtggccatggagtctgtggagcccccggtcaaagacggcatcctctaccagcagcacgtaaagtttggcaagaaatgctggcgcaaagtgtgggctctgctgtatgcgggaggcccatcaggggtagctcggctagaaagctgggacgtgcgtgatggtggcctgggaccagcaggcgacaggtccacagggcccagccgtcgaggggaacgccgggtcatacgcttggctgactgtgtatctgtcctgcctgcggatggcgagagctgtcccagggacactggtgccttcctgattaccaccactgagcgaagccacctgttggctgcacagcaccgccagtcctgggtggaccccatctgtcagctggccttcccgggtaccggagaatgttcgtcaggatcaggacaggctgagagtccaaaaaggggctttgttcccatggaggaaaactctatctactcctcctggcaggaagtgaccgagtttccggtgatcgtgcagaggacagaggccacctcccgctgccagctgaaaggaccctacctcctggtgctgggccaagatgacatccaactgagggagacatccaagccccaggcctgttttagctggccctaccgtttcctgcgcaagtacggctctgacaagggtgtgttctcgtttgaggctggccgccgctgtgactcaggtgagggcctttttgccttcagtagcccgcgtgccccagacatatgtggggttgtggctgccgccattgcccgccagcgggagcgtcttccagagctggccatgtccccaccctgccccctgcctcgggccctctccctgccctccctagagccccctggagagcttcgggaggtggccccaggatttgagctgcccactcccagaaagctgcctctaactgatcccgggcctcaaagcctaccactgctgctcagccccacacaagaaggaccggcatccggtctctatgcgtccgtgtgcaagcagaccagcaagcacacaggcacggcggagcatctctatgagaacgtgtgcatgctggaggccagccctgggctgaccaatgggggtcctgaagcccaagaaggcccccctggtggccgcagccccctgggcagccctatctaccataacactgaggatctgagttggccgggctcggcccaggacagcaatctggaagcccagtaccggaggctgctggaactggagctggatgaggccggaagcgccggccgctctggagcgcaggcaggcatcaaggccaagctggtgaccctgctgacccgtgaacggaagaagggccccgccccctgtgaccggccctgaaggcctgagcggccagccactgcaggacagaggtgatcacccaagaccaggaacaacttcgaacataacccgtctactctgacctgcagggacaagccaggtggcccggggaggagccacactctgccctacctcctccctcagactgtacagattgaacagtaataaagcttgcctatcaacttccaaaaaaaaaaaaaaaaaaa

SEQ ID NO: 198 - DNA, 1762 bp, Rat
atgactcggggagccagactgcgatcagacgcgcgtgcccagctgaaccagctgtctctggacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagctcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggcaaaaaaaaaaaaaaaaaaaaaaaaaaaaaaaaaaaaaaa

SEQ ID NO: 199 - DNA, 2409 bp, Rat
gtgtcggccgggtgaggggcgagccgctgtcgctggagggtggcccgggaacctgaggccttgcaagctatgtctgagctcagcgatgaagccagcgagccggagctcctgaagcgcagcctgtccatgtggcacgggcttggtgcccagggcagcccagaggagctggatgtccccttggatcttcacacagctgcctccattggccagcatgaggtggtgaaggagtgtgtgcagcggggagagttagatttgaataagaagaatggtggtggttggacagcgctgatgtatgcctcctacattggacacgataccattgttcacttgctgcttgaggcaggcgtgagtgtgaatgtgccaaccccggaaggacagactccactgatgctggcctccagctgtggcaacgaaagcattgcctactttctgctccagcaaggtgcagagcttgagatgaaagacatccatggctggactgcactcttccactgtaccagtgccggccaccaacagatggtcaaatttcttctggagagtggagccaatgccaacgtgagggagcctgtatatggatacactcctttgatggaagcagctgcctctggccatgagataattgtgcagtattttctgaatcacggagtcaaagtggacacaagagaccacagtggagcgacagcctgcatgttagccaggcagtttggtcacatgaagattgtagccttgatggaaactcactcacctgtactgcccaagagcctctaccgtagcccagaaaaatatgaagatctgagctcttcagatgagtcctggcctgttcctcagcgccagaggccctgccgaaaaaagggcctcagtatccatgaggggccgcgtgccctggccaagatcacagctattggactcggagggaagactcagaccacctatgagcaagtccctccacggggctacgtgaccttcaccagcagtgatgagaataccatggaaagcgagggcctctgctacagagacgtcacttcccccatcaatgaacaggatgtggagagcagtagcagcagcagccgggaggaacccactttctgtgccagtcttgggcctgtgtggaggagcagcagcagtgatggcctagcaagagcccagggtctcagcagtgaagcctccatagaaagcaatgaggattctgatcatgcccggaaaagctcggttcgaaaacaaaccaggagttatttgaagaataagagtcgtcacggcaacagtgatggtcattggccttccagcacagggcctgcttccattccagggtctgaaccccaaactgagaagtctccttactcaggaccccaggaccttgccacactgctggaacagatcgggtgtctgaagtacctgcaagtgttcgaggagcaggacatagacctgcgtatctttctgactctcactgaaagcgatttgaaggaaattggcatcacgttgtttgggcccaaaaggaaaatgacctctgccattgcccgctggcacagcagtgcccgcccacctagtgatgccctagagctggcctatgctgaccggctggagactgagatgcaggagcttgccattcagttgcataaatgctgtgaggaggcagaggctctgcgtggccaggtatcccaggagcaggaattgcgggctgtagtagagagctgcctcctggagcaggatagtgcccgaaaggacatccatgcccagctgcaggaggcccaaaccctggcccaggatgctgcccttgtcctggaccagctgcgggcctgtcaagctgagctgtcagctcgattgcggcagcaccactcccccggggaaggtactccaaacccacactttctctcagcagattccaaaggctggcccattcccctgcaggccttgagcctccctgagttgtcaggagccctggaagaccgtgtccatgagatggggcaggcgttatgctctgtaacacagagcttggagaaactacagatgctgaatgcaaagaaatggcgggaaccgtagccaggagggacgattctgacgttgggtgataaatccaccctgaagttatgtgccacgcaagacagggcagtgagcagatggctgcggcagcccagggaatagaagaccattccagggagcagcttatggacaggaagacaggactgcggtccccactagggcagcttgggccagccctgagacaggatggagggctcagcacccagatcctggtggagaggcccatgctggtaggcagctttggcccagaccaggcagggctgtatggagaggttgtgtcctgcacatgcaggtgccatactgaggtctgatcttacagacaaggtctggggtgcctagaaaatgtactctttgaaaataaaaattagatgc

SEQ ID NO: 200 - DNA, 3098 bp, Human
gcgagactctgtctcaaaaaaacaacaaaaaagtgaatcccgtaaaagggacagatcctggggttcagtcaccagttgttatcccctctgcaggcaagaactggggaagggaaagaaggcctgtgggcgttaaccatgtaggatcccaggtaaccatgcaagtgggtattattttaaatgtgactcccttgtcccaaccccagagtcgcagctaggaagcccacagttttttcccatgggaaaatgcattgccagaattttaacagcaatcagtgagaaagatgggattctttggtcacagatttttcaagaatgtttctttaaggtgaggtgacaaaggatgaatcagtggcggtgggacttgtccacggtggagtcccttctttcctcactgctcctctccacccagcagtgggctagtagatgccaggcctgtggtggtcagggtttttcaactgtggctgtgttgacaatccaggctggatcattctttgctgtgggggctgtcctggacactgtgggatgtttagcggcagccttggcctccagcagcccttccctgcccagttgtgagaaccaaaaatgccttcacacattgccacatattccctggttgagtgccatctgcctatctggtggtgtgaaagagcatagctggccttgggctaggaggatgcgaaatcagagcaaggagacgaaggctcagggcctcacaaggcagtgtacgagcaactgtcagcatttttctgcctgcctgcctccaatccccacaacgtccagggtggcagataacttctgcttcctgtcaactcatcccgcctggcctagcctcgccaccagctttggtgaaccccacatgcgaggcggctggccatgtctagcatatcttgcgtttgtttaggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagct

SEQ ID NO: 201 - DNA, 313 bp, Rat
tctggaggacttcataggcacagtgaaatcagttttttattcaaatgaagaaaatatcatttctcaaactacatgaatggaagtcaacaatttttgtgaagaaattaaaactatttatattaacaaaaataatgtcagtagttaaaactaatgtctgttatttcatagattctcaactagaaaacatttgcatgagtatttagatgtataacaagatagaaaacaaagaaaggaaaagataagtgaacactaaaactaatgtgtatataatggtgttataaaataccaacttaactttcatctgttaattgac

SEQ ID NO: 202 - DNA, 554 bp, Rat
cggacgcgtgggttctgccccaggatgccaactttgaataggatgaagactacaacttgttcccttctcatctgcatctccctgctccagctgatggtcccagtgaatactgatgagaccatagagattatcgtggagaataaggtcaaggaacttcttgccaatccagctaactatccctccactgtaacgaagactctctcttgcactagtgtcaagactatgaacagatgggcctcctgccctgctgggatgactgctactgggtgtgcttgtggctttgcctgtggatcttgggagatccagagtggagatacttgcaactgcctgtgcttactcgttgactggaccactgcccgctgctgccaactgtcctaagaatgaagaggtggagaacccagctttgatatgatgaatctaacaaaaactgcagtctcaatttggaaatctgactcatgtgcctttaaatgtgttcatattgcccatttaccctgcttcttgaaatgcttcttgaaaaataaagacaaatttgcatgtgaaaaaaaaaaaaaaaa

SEQ ID NO: 203 - DNA, 216 bp, Rat
  misc_feature (56)..(70): n=a,c,t or g
gtcagcaatcccatggcgtataaaagcatctcatctggccaggtcctggaaccttnnnnnnnnnnnnnnnccaggatgccaactttgaataggatgaagactacaacttgttcccttctcatctgcatctccctgctccagctgatggtcccagtgaatactgatgagaccatagagattatcgtggagaataaggtcaaggaacttcttgccaat

SEQ ID NO: 204 - DNA, 453 bp, Rat
atgcaagtgctaacgaaacgctatcccaagaactgcctgctgacagtcatggatcggtactccgcggtggtgcggaacatggagcaggtggtgatgatccccagccttctgagggatgtgcagctgagtgggcctgggggctcggtccaggacggagcccctgatctctatacctacttcaccatgctcaagagcatctgtgtagaagtggaccacgggctgctgccaagggaggaatggcaggccaaggtggctggcaacgaaaccagcgaggctgagaacgacgctgctgaaacggaggaggccgaagaagacaggatctcggaggagctggacctagaagcccagttccacctgcacttctgcagcctccatcacatccttacccacctgacccggaaagcacaggaggtgacgcggaaataccaggaaatgacagggcaggtcctgtag

SEQ ID NO: 205 - DNA, 1190 bp, Rat
aaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggacactagggaagatcccttcacatgatagaagacagactctttgatgaggtcggcggagcagttcactagccaatgatgagagcagaaaggcctagacctgcagccagaagtgaaggcggctcagttctccgggatgcttctctacctcctgagcaccaattcctggattccagtcactggctcacctttagaatgtctgttgctattcactgctcccctcgctcctcttaacagcttggggaggtgaccagtggttcaggagggactagacaattacctgtccagtgtggtatggtaggaagagtgtaggtgttggcacgtgaccaaaattcacatccctcctcatggcagtcattcagtatgtgtacttgtacaagttatttaacccattggagcctaaattccctcatctataaaatggggataatattatctacctcccaagcttatgaaaactaaacatgatgaatcaaaagcccttggcatgtgagggctattaaaatagcctgattttttttttctccccctctccccaatgtatttgctctggcccttgctttttaccctccagagctaagaggtagcagagtctcttgggatgagtgattcaccctcttacttggcgaccactgatgagatcaacaacaggtgaactataaacctattatttattgcagaactaataaaaaatccaaagccttgtaaaaaaaaaaaaaaaaaaaaaaaaaaaaaaaaaa

SEQ ID NO: 206 - DNA, 1717 bp, Rat
ggcgcgcggcggcggcgacccctacagcgacctcagcaagggagtgctgcgctcccggaccgtggaggacgtgctcacgccgctcgaagactgctttatgctggactccggcactgtcctagacttcagcgtcctcgccagcatcatgcagagcggccacacgcgcatcccagtgtacgaggaggagcgctccaacatcgtggacatgctctacctcaaagacttggctatcgttgagcccgaggactgcacaccgctcagcaccatcacccgcttctacaaccatccactccactttgtcttcaacgataccaaactggacgctgtcctggaggagttcaagcgaggcaagtcccacctggccattgtgcagaaggtgaacaatgagggcgagggcgaccccttctacgaggtgctgggcctggtcaccctggaggacgtcatcgaggagatcatcaagtctgagatcttggatgagtctgaagactactcagacacaaaggtgaggaagaagaccgtcgccctgggagctcctctcaagcgaaaggaggaattctccttattcaaggtgtctgatgatgaatataaagtaaaaatctcgcctcagctgctcctggccacccagcgcttcctttcccgagaggtggatgtgttcagcccattgcgagtctctgagaaagtcttgctgcacctgctgaagcatcccagtgtcaaccaggaggtgacgtttgacgagagcaaccgcctggccgcacaccattatctgtaccagcgcagccagccagtagattacttcattctcattctgcagggcagagtcgaggtcgaaattgggaaagagggcctgaagttcgagaacggggccttcacgtactatggagtgtccgccctgacagccccatcctcagctcaccagtccccagtgtcttcacgccagctcatccgccatgacgtgcagcctgaaccagccgatggtacccgctcctgcacatactgtcctgactacactgtgagggccctttccgacctgcagctcattaaggtcacacggctgcagtaccttaatgcactcctggctacccgagcccaaagcttgcctccatccccagagaacgctgagctccaggctatcccaggcagccagaccaggctccttggtgacaagtccagagagacagcagggtccaccaacagcagacccagcatcccagtggaggagagccctgggcggaacccaggagtgtaactgcttgccggacagccccgagctggaaatggacaagcgtttggggagctgggagagccgagcaggagcttcatgccagcctgtccccacctatcctggccacgttttagatggcccttgtaagctgtgggtcctgagccgcctcggtgccagagcctccagccgtcctgctgtccttgaggagatggggttgacaaagcggccctccagaagcctgtttccgaggggacaaaagaaacagcgtcatctctagtccccagctcccagcttccccggtgctgtaacagcacagtgtgtttatgtgtctccctgagcccagggccatgcgggtacagccactgcctttacatggccctggcctgtgctcattctgcttttggttggccaaccctctgtcagtggcgccactttctgagcaagccaagagtgctgagttttgatggaagtgttcaaaaaaaaaaaaaaaaaaaa

SEQ ID NO: 207 - DNA, 2234 bp, Rat
tggcgcgcggcggcggcgacccctacagcgatctcagcaagggcgtgctgcgctgccggaccgtggaggacgtgctcacgcccctcgaagactgcttcatgctggacgccagcaccgtgctggacttcggcgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgagggaagtcccacctggccatcgtgcagaaggtgaacaacgagggtgaaggcgaccccttctacgaggtcctgggcctggtcaccctggaggacgtgatcgaggagatcatcaggtccgagatcctggacgagtctgaagactaccgagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctaaaaaaaaaaaaaaaaaaaaaaaaaaaaaa

SEQ ID NO: 208 - DNA, 1585 bp, Rat
gaattcggccctccatccaaccgctgtgccgcagccgcatcgccaccggcagccgtaggcagagcccagtcgggcccaggcccgtgtgtctgccgtgggcttagctacgcgcccgcccgtcgcgcaccttatccgcacatcccttggaggtctagcccggtgcccccagaccccgcctccagacagagcaagagcagagagagcacgagcggagacgaagaagggagagagccgttgcagatgaaggagtggactcaggagcgtcggagtgcgaaagacagtgatgatgaagaggaagttgtccacgtggatcgagcccactttatggctgagttcttcgagcaggtggaagagatccgaggctgcatcgagaaactgtccgaggatgtggggcgagtggggggacagcacagcgccattcttgccgcccccaagcccgatgagaagactaaacaggagttggaggacctcacggcagacatcaaaaagacggcaaacaaggtccggtccaagttgaaagccatcgagcaaggaattgagcaggaagaggggctgaatcgttcctctgcggacctgcgctaccgtacgacccagcactccacagtctcacggaatttcgtggaggtaatgaccgaatataatgcaactaagtccaagtaccgggaccgctgcaaggaccggctccagaggcagctggagatcactggcaggactactaccaatgaagaactagaagacatgttggaaagcgggaagctggccatcttcactgatgatatcaaaatggactcgcagatgacaaagcaagctcggaatgagatcgagacaaggcacaatgagatcatcaaactggaaaccagcattcgagagctgcacgacatgttcgtggacatggccatgctcgtagagagccagggtgagatgatcgaccgaattgagtacaacgtggaacattccgtggactacgtggaacgagccgtgtctgacaccaagaaagctgtgaagtaccagagcaaggccaggaggaagaagattatgatcatcatttgctgcgtggtgctgggggtggttttggcctcctccattggggggactctgggcttataggccctacccttcttttccccaggacccttcccacacatctggagcaatacccccgacccttttacctttccttttctaagctcactgcacaaaacaggcccaggaagttctagccactgtatcctgcatgtagaccctgggggccttgggcttaacgttgccgcacaaagatagcagaagacgtgctaaacattgacaccaatatgcatgcccgagggcacattctcaagacgtgtggaaaccccaagcgtgtgtgtacttgtgtagatgtatgtagatgccccgaccctcttgctgccaccttcatcctgtgtggtctgaacttccctctctatctggctgctgtgctgactgaagaaccctaccaggacccaacctgctctgtgtgaaaagacagggacagtttgcgtgtgtgtgtgtgtgtgtgtgtgtgtgtgtgtagatctgtgcccatacagtgtatgtgtgacccgaattc

SEQ ID NO: 209 - DNA, 1709 bp, Rat
gacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccctcctccacccccacggcagaccctggtgtccctggacctcaccgggccatggacccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagcc

SEQ ID NO: 210 - DNA, 4152 bp, Rat
gagaggcctcgtcccttgctattggcgtgtaagcacccgccgggcggcaggtctgcttcggatcgggcttttgttcggccccctgggctcggggctgggttttcgccacctctgtcccggcggaggggcgccgcccgggtcctcgctgtaccgcggggtcgctgcgcgccgggcgggcgcggtctgaggttgttggcccgagaagcaggcgggcttgttgcagctaagcgtcccttccggtttcggaaggagaagcagagctttgttttgtttttcggtttctttctgtctcggtcttccgctccttggcccccctgcgacccagcggaattgccttgcgctccgccttcgagcgcccaggcctgtgtgagcgccgcggcccgcagcatcttggaatctgtttgcatttgtggtacttaagagtgccttcctagaaaaatggaaaaacagaattagaggcgtgaataccttgtggaagagattaaaaggtaaaattgtatttacaggatcttgctgcataggcaaagctggcctcaaagctgtgaccctctttctccagcctctgatgctggggctacagatttatgacattcaaaaccacagactttacaatactgctaagtcagatcaactatgaattgaaatacaaaacaagagaatgttcccaaaccctcaccatattctaaaacccagtcatctaacttgcagcattttttaatgacttctacaacatctcaaagttctttcaactattctccccataaccaagaagcatctcaaacttctttcaactattctctccataaccaagaagcatgcatgtattctgggaattcaaattcagtttcacagccacttctgagcggcagaaattatataactcctcagactcagatctctgtttctaatatgcctaccagaacaattgtggcctcacagtcttcaatggaaagagttgtatctacaaatggtaaaggaccacaacaaccaaaccacaatttgcaaacagtgtcttcaggaattatgcagaatgtctggttgccttcccatacagaagcaaccatatctcataatccgacggagggactaatatgccttacatgcatccaccacagaatcggcttgtcacatcagatacctattctatgcaactacaaatggctcctttacattctggaaaagtacctatgacacatcaaggaagtcagggacttaatcacttcataccagatcagttggttgactggacacagtatacatccaacgaactttcttatcctgaatacaggccacctccaaagcaatactcctacatactgccagctactacatcattacaagttaaaaataatcagctcccaacttatacacagagcttacagtcaaagcattctgtacctttgtcatcacatcagtatgctgcagaagccagcaaaagactctctgcccttccttacagctgtagatatgaaaaccaacatgtgcagaatgctcagcctgtttctaaacacttgcctatggaagttcctcagagttcagaagtgcactcatctgaaaaaaagaaagatacttacagaggctttaagcagcagtggcagaaccctaatgagaaagtcagcattggacaattctctgaggtgaaaataaatatcaagcagccttacagtgaatctgttagaccttctggggatggtgttcaggcacttgttcaaaataatcaagaaaaaagaaaatatacctacaatcctaatacaaatcaagtaatagatacaaatgccacaaaagaaaagctggtgagggatattaaatctctagtagaaatcaaaaagaagttttcagaacttgcaagaaaaattaaaattaataaaagtcttttgatggcagctggttgtagtaaaacagctaatacttcttatactgaaccaattcagcattctgaattttcagcaaaagaaatgtctgctaaaaatggcaatgactgttccatggaattgctagcaacatgtctttctctttggaaaaaccaaccttcaaaaaccacagaagaaaatgttccaaaacctttagaagaaaaacagtgtaacacatcaagaatcagtacaaccgtagtgggcagtgccaatcccacaaatgaagttcatgttaagagtttgtgttctggtgttggaaattctcagaaaatgatgagctcatcacaaacagtattgccagttctcataccgagctgtgagtcttccggtgtagctgtaggaaaaggaacagagcttcagattgctgtggtgtcgcctttagttctttcagatactaataccttacctggaaaagactcagtgcctgaagttttacctgaaacactgtatccagttgttaaggaaggtagtgtttgtagcttacaaacccaaccaacagaaactgttgctttaccttttgatgttataggagctgtagcaagtaataacatatcagcagagattcctctgcctgttgataaggaaaagcagcacaaaccaatacagggtgatccagacatagctgatagcagcttaggaaaacactctcctctgggcactgaagttctgcctaagcctatggatagcaccattgtgagtggacctatgttacaaatcgaaagtatctgttctcttgcagaaggggatgtatcttacaattcccagatagctgagatattcaactctgtacaaactgagccccagaaaccttcacctaatcaggtaattgatagtcaacaagaacaagtatatgataccactgaaaataaagactttagcttacagaaagataagtgtgtacagtgtacagatgttcctcatgaggtccctgagcagccagagcctctgcagcctgaagagccagcatctagtgagtatgtggaagcaaacagagaagccacagaggaaagctgtagggagtacactggtagaaaagaaagtacagctaaggatgtatgtttaccagctgctattcagcaggatcctcaccctcgggaaactgatatgttcagtaaatcagaccacagtcttcctgcaataaatgagattaatgatgaaagtgaacctatctcatacctacatgaccagctgtcagagcttttaaaagagttcccttatggcattgaaacttttaacagacatgaagtgtctttggaccaacaaaagacacataaaatcgtagaaaatcaaactggtggtaaaactagtaatgtgtctggggatagcacagaccaaataaaaattacagtattaaactctgaacaaatcaaagaactatttcctgaagatgatcagccctgtgacaagttggcggaacctgagaataaagaaattgttgcggaagtaaagagcccatgtgactcacagattcctagagaagaaagtcatgaccttggaatgttggatccagagaaagacaaaatccattgctgtgccttgggttggctctcaatggtgtatgaaggtgtgccacagtgtcattgcagttctacagaaaagaaggagaaagaccagtgtttggacatcaacagcagcaaacaaggagagcagccctgcaatagtggaatcactatttttgaaattaatcctgtttctaataactcaaaaactcctctgacccaagcaactgaggaaggccatttttctgcagtgcatggtgaaaagaccaaagcatctaaaacaaaagacaacagggagggacaggaattagcctgtcatttttcagctaaatgttacaaaaaagataaaaaaggtaattttaaaataaggcatgatacctcactgaaaatggagcaaaaactaaaaaatatttcatctaaatgtgacataccaaacccctcaaaatgcaataagatagcagcccctgaaatacttcacgtaacaacttctaactctgctaaaaatatgccattttctaaacaagcctctcaggaaagcctacagaagaaacacacgtcccaagacttgggtccagtaaaagcacctatagaactttcgtcaaacacagatccgtgcaggagtaatacctcttcagtacagtcagtatcaccagaaaagaaaaaactaaaattcaaagcaggtggctccaggttgaaatattttgaaaaaagaaagacggatcacgttattattccagatgtag

SEQ ID NO: 211 - DNA, 530 bp, Human
  misc_feature (124)..(124): n=a,c,t or g
  misc_feature (129)..(129): n=a,c,t or g
  misc_feature (167)..(167): n=a,c,t or g
  misc_feature (191)..(191): n=a,c,t or g
  misc_feature (196)..(196): n=a,c,t or g
  misc_feature (231)..(231): n=a,c,t or g
  misc_feature (244)..(244): n=a,c,t or g
  misc_feature (255)..(255): n=a,c,t or g
  misc_feature (257)..(257): n=a,c,t or g
  misc_feature (316)..(316): n=a,c,t or g
agagttcccttatggcattgaaacttttaacagacatgaagtgtctttggaccaacaaaagacacataaaatcgtagaaaatcaaactggtggtaaaactagtaatgtgtctggggatagcacngaccnaaataaaaattacagtattaaactctgaacaaatcaangaactatttcctgaagatgatcanccctntgacaagttggcggaacctgagaataaagaaattnttgcggaagtaangagcccatgtnanctcacagattcctagagaagaaagtcatgaccttggaatgttggatccagagaaagacnaaatccattgctgtgccttgggttggctctcaatggtgtatgaaggtgtgccacagtgtcattgcagttctacagaaaagaaggagaaagaccagtgtttggacatcaacagcagcaaacaaggagagcagccctgcaatagtggaatcactatttttgaaattaatcctgtttctaataactcaaaaactcctctgacccaagcaactgagga

SEQ ID NO: 212 - DNA, 692 bp, Rat
ggacccggagatcggtggagagcggagagcttggtctgcactgcctacgccgttggcagcgaggctgtctccggaaggcggaccggcgctagcccagtacccgctctcggctgcccgctgctctcctctgcgcccctgccaatctcattcaggactcagtgactggtttttttttgtttgtttgtttgttttgttttgttttgtttttcttaatcacaagggcgtgggtcagcctcccctaggacttcatgtctgtatatttccccattcactgctctgactatctgagatcggctgagatgaccgaggtgatgatgaacgctccatccatggaagagattggtctcagcccccgcaaggatggcctttcctatcagatctttccggacccatcagactttgaccgttgctgcaagctgaaggaccgcctgccctccatagtggtggaacccactgaaggggaggtggaaagcggggagctccggtggcctcctgaggaattcctggtccaggaggatgagcaagacaactgtgaagagacaacaaatgaaaagaaggaccagtagagtccacgcaggctcgcctgggtcatgccagccagcacacctgaactgtttttcccatggtgatggaagaagagaatgagccacagtcattgtgaaaatgtcaaacgaggcttccgttttgcaccc

SEQ ID NO: 213 - DNA, 2955 bp, Rat
ggggggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgccgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgccttttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggccgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccagggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctcttttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctcaaaaaaaaaaaaaaaaaaac

SEQ ID NO: 214 - DNA, 1670 bp, Rat
tctggcccagcgtgagaacaccgtagctgtgcagagggcagctgaccactacagtgagcagatggtccagcgactgagccttcccacagacacgctccaggagctgctggatgtgcatgcagcctgcgagaaggaagccatggctgtcttcatggagcattccttcaaggacgaaaatcagcaattcctgaagaagctggtggaattaataggtgaggcgaaagtgcttttcctgttgaagaatgaagaggcatctgataaatactgccaggaagaactggatcgactttcaaaggatttgatggacaatatctcaacattttctgttcctgggggacacaggctctacatggacatgagagagaagattgagcatgattactggcaagttcccaggaaaggggtgaaggcaagagaagtcttccagagctttcttcagtcgcaggccatcattgagagttccatcctgcaggcagacacagccctcactgctgggcagaaggccattgcagaggagcgcaccaagaaggaggcagctgagaaggagcaggatctgctaagacagaagcagaaggagcagcaggagtatatggaggctcaagagaaaaggaacaaggaaaacatagagcaactgagaaggaagctggagcaggagagagagcagctcatcaaagaccataacatgatggtggagaagaagctgaaggcacaaaaggctttgcttgaggaaggatttaagaagaaagctgaagaaatggacggagagatacagcaactgaaacataacatcgaggatatgaaaaaaaaacagtggttccattttcgatactattataagagaagtgcttcattattttttctcccatttcaatgattgaaaagggtataagtcccttttttagtaaaaatgatagactgtgatatacactttgtgttactttgacgctgcctgttttccattttcactccgcagagaagtttaaacataaaaagtgctgattagagggcatctgtgccccacacagaagacatagaacagctcctacatgtctgcacagacaatgcttgcctttagagaacatattttgaaaccattcctatgaaagctatgcatttagtcatcagatgtgatcactgctggccaatttaactacatatagaatctgcatatagaatctgtactcctatgaggaccatgtagcccaggataggttgtacgggattctctcaggttaatatggtaggaaacccatcctaagtgtgggcagcaccattcctgtggactgaagacacagtagaaagatgaaagcaatctccctaccacttgtggcttcaactgtggatgccatacaacaagccagccttgacttctctcagaatgcattatccagccttgaccgaatgtatcatcatgatacatggagctcaacaaaccattcattaagttggttttgtgagggtatttcatcacagcaagaggaaaagtcactgatatcataatagtgataatcctggaaactacttaatcatccctgagttagattggcaataaattttaatatgacttgttcttggagtactgtatagtcaagaaacacatgtcagtcaaactatctgtatagtgatctaaattgagctaaaatatatcttaaaaataaagtcaaaacacc

SEQ ID NO: 215 - DNA, 1352 bp, Human
gtcctttcaatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagaaaaaaaaaaaaaaaaaaaaaaaaaaaaa

SEQ ID NO: 216 - DNA, 3871 bp, Rat
ggacatgtgggctcgccgtcgccagcgttgcagctgtccccgcgagatgggcagtaacccctatgccaggtagcatcctgcaccaactttgactatcaacaggaagttactgggtagcgaacactcaagatcacaacttactgctgcagtaacttggaaagagaagaaaaccagaattgaaaccatgacgaagataactagagtcagcttggcatcccctccagatggaggctggggctggatgatagtggccggctgcttccttgttaccatctgcacccgggcagtcaccagatgtatctccatattttttgtggagtttcagacatactttgctcaggattactcccaaacagcatggatccattccattgtagactgtatgacaatgctctgtgctccgcttgggagtgttgtcagtaaccagttatcctgtcaagcggggatcatgctaggtggcttgctggcatctactggtttcatcctgggctcatttgccaccagcttgaagcacctctacctcagcctgggagttcttacaggtcttggatttgcactttgttactctccggcaattgccatggtgggcaagtatttcagcagacggaaagccctggcttatgggattgccatgtcaggcagtggcattggtaccttcatcctggctcctgtcgttcagctcctcatcgaacagttttcctggcgaggagcactgctcattcttggcgggttcgttctgaatctctgcgtctgcggcgctctgatgcgtccaattacccttaaagaggaccgatcagtcccagaaaagaatcacaaccgtgaatctcagcgagaagactgtaagcaagcatctccctattcacctttgaccaaagaatgtacagagacccgtctttgctgctccttgcagcaggaatacggttttttactgatgtcagacttcgtcgtgttggccgtctctgttctgttcatggcctacggctgcagccctctctttgtgtacctagtgccttatgctttgagtgtcggagtgagccaccatcaagctgctttcctcatgtccatcctcggggtaatcgatattgttggcaatatcacatttggctggctaactgacagaaggtgtctgaagaattaccgatatgtttgctacctctttgccgtggcactagatgggctgtgctatctgtgtcttccaatgcttcaaaccttcccccttcttgtgcctttctcttgtacctttggctactttgatggagcctacgttaccttgatcccggtcgtgactgcagagatagtagggaccacctctttgtcttcagcacttggcgtggtctacttccttcatgcagtgccatacttggtgagcccacccattgcaggatggctggtggacacgacgggcagctacactgcagccttccttctctgtggatttgccatgatatttagttccatcctgcttggcttcgttagaattgtcaagaggatgaagagaacacaagtgcctttcccggtcaaagactcagatcccaagctacaactgtggaccaatggatcagtggcctactctgtagcaagggagttagatcagaaagatgaggaacccctgcctaaagccaggtctggttgcaacctcacgtgacatccctgggaatcttcaaggctggtggaccccaggccaccaggttgttcatggtctggaaatattttattttgacagagtatcacctcccaagtaaattattaatactgttttgctaacatatttatatgggggaaaataacgagcaacgaagaaatctggagtagcctggagttttctcatttgggatttgtacttacttagctccaggggaaagtcagggcatagtttatgggattagctgtatttcaaggcaactccaaggcagaggccattgagaatgggttttgtcataacaaaattgacccccaccacctcattctgaatggaagcagtgagtatgctggcagtggagatgcagaggtggcttgagggcagagtgcctcaatttttagagtggcaaagaagttcttgagactctttgaatgataatgattagtgtacaacagatgttctctcatcagttccctgcctcttccaatgggcatcactttgagagacccaagaatcatcaaacaccatggctggaatggactttagagggtggctggtgataatatttgatttgaaactgtcttgttgaaacaggaagctcttttcttcagactgtgcccccaacatgcacctcggtcactaccgcatactgactctaaatgtaacataactcattcaatggtggaataactgctccatcttttctgaagggattgtaacacaccagaaatcctcatctttttttttttttcttcagaaaaaaaaagttctagtttgaactgtagacacattccttttaggaacagaaaaatgttgacagtattcccattgagcagtaattgaattcttgagtcagcaggtatctggtgggagtcttccttacaaagcagtcgttagattcagcattatccaaaagagggcttgggggttttcttatcatacagatgttctaaacatggccttcggagatcactgtgtctcttgctagatgatagttataaatctgactcattggcttggaagcatctgctccttcttgaaagccagactttcttggtacttggaatcctttctgaatttttagatcagaggagaggacaaggagaagaaaaaaaaagaagagtgggtcccccatcttatctccagctgttttcaaatccacacaatgaagattcctgaatccccagtcatgttccatctgcaaagaaggacaagttacataattaaaggacttttttttagttgttcaagaggttaaatacaagtcacaaggaacattttgatctcaaaggccatgtaacctactgtcaccaagaggtcccagcgtggctttagccagacacagtgctgggagaaatgaccaagttttgaggaatggctgaagtggctgaatcctcgttgaactgaatatctttaggttactatattgctttcataacgagactctggcttgatccgatggagaaattgatactagtccattgtagcttttcacagaaaaatttgaatgttctgtctttactcagcctgggactttagttttgaatccattcacttagtgatttgcaattttaaaaatactttgggtacaactttaaaaaactcaaagttaaaataaaatacttgttttggaatagcactttaccttaagagacatttttttaatcataaaaatgattttttaaaaatataattactcttatttgtatgttttaaagcattgattataaattttgtgggattctataatataatttctctattgtgcttatgaaaaaaataggatagtgatcaagggttttaaaatttatataaaaacattttagatcttttgactttatacatgcaataaatttgccttctaactatcttgggacaacatttttgaagaaccagtaagaaacactgtagatcttagagtttacagtttggtcatctgtacaacatgttactaaaacaatatctccgtgtatttaaacagttggttccaaagctaagggaatgggatattttgtggaatggagaataaacctgtagaggaatgattctatgccttaaatattttttcacccaactgtaagttctcctttgtaactaagtaggaaaacgacaatatctaacgtttcaatgtgccattctttcttttgcttaaattagaattttatgaatgaatcagatgtgtaggctaatattttcctagttcaaaggcaaaataaaatggatttatagacc

SEQ ID NO: 217 - DNA, 717 bp, Human
cagagcagaaccatgtgtgtagaactcagaaagaagacattaagcgggtgtctccctattcatctttgaccaaagaatgggcacagacttgcctctgttgctgtttgcagcaagagtacagttttttactcatgtcagactttgttgtgttagccgtctccgttctgtttatggcttatggctgcagccctctctttgtgtacttggtgccttatgctttgagtgttggagtgagtcatcagcaagctgcttttcttatgtccatacttggagtgattgacattattggcaatatcacatttggatggctgaccgacagaaggtgtctgaagaattaccacatttttagaaaatcagtaagaaaaatgtacatcttaaggtctactattttacatttctacacagaattttagtgttaatgttccatgtgtctatactgtttatttcaaaactgagaaattcatgggaatgatgtattttgtggaatcaagaacaaaattatagtgggataattttacatcttaaatatttctttctactactgtaagctctactttggaattatctgagtagaaaatcagaagacattatctaactttgtagatacactgtatgattgggctttttgttcagattgtaatttcattaatagatgaaatatttatgctaatattttcttatttcaaaagcaaaataaaatgaatttattgtcctgtg

SEQ ID NO: 218 - DNA, 1956 bp, Rat
ggggcgtctgtgccagcctgtctttggagagtgtagagcaatggagggaagactggatgaacagagagcatgccccagtctcacggcaaccccccagtgctgacagagcgttgtgtggatttcaggctggcacaggactgagagctctcctgaagatggaccgtcacaacatgtcctgggtctgctacccgagccatgtgtccccggctgtggaggaagtcattgcagcacagagcatcatttctaggtgcacgcaggtgtacatagcagtgtgcgtcccactgagcctagtgatggggctcttcagtctgagcgtgttcatcttagaccgtactaggctgggggtgctggacaggctccttgcaggcctcacagccactagtatcctggtgactctactgtccctcaatgctgctgtccgacccgactacatgtccacgacaaacctgggctgtggcgcactctcattcttctccaatgtctgctacttcatggcccagtacctgcagggagccacgcttctcctgtcctttctgccggaatcaccctgctgccggctcttggcaaggcctatggcaagcctagctgccattgggggctgtgcggtctgtagctccctgattgtggtgtccctgctgggcacatctggggagttgcacacaaccaccatgtgccaggcggatccgctgactgcatggcccgaatatgagatcgtcaagttcagcctgggctttgctcttgccctgagcttccagatggttctattgctcctgtatgctacacagccagtctggcgagcagctccttctcaaagggacacagcctcggggcgctgggtggtactggctgtggctctcaacatgcttgcctgtagactcttcttcaatgtggtcctcctgcatcgggcccgcctgaagctgtggaaggatgtgggctccccctgggatgaactgctcatgaacctcgcagagctggtcctgtctggagagagctgcatcaacgtggtggccatcctcctcctccacacaccatgcaggctcaggctgcttggcctccttgagcgcctcacacagagatgcaggccagggctggacaacagcatgtccttgaacagagtagggggctagatagagtctgcctgctggcacaggccacaccccttgctgtgttcagggaagactgccttcccagggagcctgagcagggttcatatgttttggatggttggcttgcctgtattcacctcaacttatgcaaaacaagaccatttctcttcccacactatcagtcacaccttgagagacacagtgacatggatacaaaggctggccaaagaccatgggtctgctggagggtgtctggactatgacggccatgtgtgggacacatgtgacagaccaccttgcctgttggtagccaccttccactcaatagtccaatcttaccacacaagaaaggcattgtagaaataaactcagctctcacctcaggtcttgtttcttgagaccagatctcactgcagccttggatggtcttgactctcagtcttcctgcctcacccctgatgctggggcttcaggccacgtcaccacgccttgcccctcgctctatagccattacattctggtactgtgcagttgttgccagctcgctttcaactgccagagaatttgggcaatggaattcctgtcagaaacaacctttaggtttatcttttaaaaatctgtcatcacctgctcgggcaggagagatggctcagcagtccagagtgcacagtgctcttgcagaggcccctgtgatcagttccttacatctacattaggtgacttcaactccagggggatccaatgctttcttccatgggcacctggactcggatgcatatactattccccaccaccaccaccagacacacacagtttaaaagaatacaaataaatcttttaaaaatctgtc

SEQ ID NO: 219 - DNA, 2610 bp, Rat
ggcgcacgccggtaggatctgcctcccaagtgctgggattaaaggcatgagccaccactgcccgctgactacagtagtgagggctgctgtggctgtcaggatggctgaggagcaggactttgcccagctgtgcaggctgcccacacagccctcccactcccactgtgtcaacaatacctatcgaagcacacagcactcccaggccctgctccggggcctgctggctttgcgagacagtgggatcctctttgacgttgtcctggtggtagaggggaagcacattgaggcccatcggattctgctagctgcatcgtgtgattatttcagaggaatgtttgctgggggattgaaggagatggagcaggaagaggtcttgatccacggtgtgtcttacaatgccatgtgccaaatcctgcacttcatatacacttctgaactagagctcagcctgagcaatgtgcaggagaccctggttgctgcctgccaacttcagataccagaaattatccacttctgctgtgatttcctcatgtcatgggtagatgaggagaatatccttgatgtctaccggctagcagacctctttgacttgaaccatctgacccaacagctagatacctacatcctcaaaaactttgtggccttctccagaactgacaagtaccgccagcttcccttggagaaggtctactctctcctcagcagcaatcgcctggaggtttcctgtgagactgaagtgtatgaaggggccctgctctaccattactccctagagcaggtgcaggctgaccagatctcactgaatgagccccccaagctcctagagactgtgcgctttcccctgatggaagctgaggtccttcagcggctgcatgacaagcttggtcctagcccactgagggacacagtggccagtgcccttatgtaccaccggaatgagatcctgcagcccagccttcagggcccacagacagagcttcgctcggacttccagtgtgttgtgggctttgggggtattcactccacaccgtctacaatcctcagtgaccaggccaagtacctgaatcctctactgggagagtggaaacacttcactgcctctctggcgccccgaatgtccaatcagggcattgcagtgctcaacaacttcgtgtacttaattggaggggacaataatgtccaaggatttcgagctgagtcccgatgctggaggtatgacccaaggcacaatcgctggttccagatccagtccttgcagcaagaacatgcagacctatgtgtgtgtgtagtgggcaagtacatctatgctgtggcaggccgtgactaccacaatgacctgagtgctgtggagcgctatgaccctgccaccaactcctgggactatgtggccccactcaagaaggaggtatatgcccatgcaggcaccacactgcaggggaagatgtatattacctgtggtcgcagaggagaggactacctgaaagagacacactgctatgacccaggaagcaacacgtggcatactctggctgacgggcctgtgcgacgggcctggcatggcatggctgccctcctcgacaagctgtttgtgattggaggcagcaacaatgatgctggctacagaagggatgtgcaccaggtggcttgctacagttgtacatctcgtcagtggtcatcggtctgcccactcccagctgggcatggtgagcctggcattgctgtgctagacagcaggatatatgtgctgggtggccgctctcacaaccgaggcagccgtacaggctacgtgcacatctacgacatggagaaagactgctgggaagagggaccccagctgaacaattccatctcaggcctggcagcctgtgtgctcaccctgcctcgatccctgctccatgagcaaccccgagggacccccaaccgtagccaggcagatgcagactttgcttctgaggtgatgagtgtgtctgactgggaagagtttgacaactctagcgaggactagggctctccccagtgtttgggtgttcaggaagggtaatgggcagtgaaggccgtagagcctgggttagaacaccaggctctaggggaggggcccctccttaagccatcctggttcaccagctgcccctttcactctgtttcttcaaccagccagctgccagcatttgtaaactctgtggctgtgaattacattacaaagaaaagtgctggggggaaggctgctatcatcagagggaatgacccatcctctataaactctgaatgagtgggatctatttggccgcttcttctccctagtctggtccctgatgggttaagtaaggtccttctttcaagagatcctggggagagcactcctagccatagccaaagtttgtggctccctttctgtgaaccgtggtcagtctggtgagcagcgccagctgcctgcagccagggccttgagcactggggagctctcaaggtatactcttagagtaactatatacctgtaactggacctggagatgaagagataccctcattgctctgtgtctgacccaatattgttgaaaaatgaaataaagcattatgcaaaaggtgttacatctaaaaaaaaaaaaaaaa

SEQ ID NO: 220 - DNA, 2602 bp, Human
ccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgttaaaaaaaaaaaaaaaaaaaaaaaaaaaaaaaaaa

SEQ ID NO: 221 - DNA, 2683 bp, Rat
gacgcggcgctgcggcccgcctggcctgcaacgctcccaccggctcggcggcacgatgccctttgacttcaggaggtttgacatctacaggaaggtgcccaaggacctcacacagccgacatatactggtgccattatctccatctgctgctgcctcttcatcctcttcctcttcctgtcggagctcactggattcatcacaacagaagtggtgaatgagctctacgtcgatgacccagacaaggacagcggaggcaaaattgacgtcagtctcaacatcagtttacccaatttgcactgtgaattggtcgggcttgacatccaagatgagatgggcagacacgaagtgggccacatcgacaattccatgaagatcccgctgaataatggagccggctgccgcttcgagggccagttcagcatcaacaaggttcccggcaacttccatgtgtccacacacagtgccacagcgcagccacagaacccggacatgacacataccatccataaactctcctttggggatacgctacaggtccagaatgttcacggggctttcaatgctcttgggggagcagacagactcacctccaaccccctggcctcccatgactacatcttgaagattgtacccacagtgtatgaggacaagagcggcaagcagcgctactcctaccagtacacagtggccaacaaggagtacgttgcctacagccacacgggacgcattatccctgccatctggttccgctatgacctcagccccatcacagtcaagtacacagagagaagacaacccctgtacaggttcatcaccacaatctgtgccatcatcggcggaaccttcactgtcgccggcattctggactcctgtatcttcacagcctcagaagcgtggaagaagatccagctgggcaaaattcactgacgtcctgtccagcccagtgactgaggaccaggaaccctgctagccctgcctctggcgtcctatctccttctgccttctctggcccagtgtgtgtgggaggagggtgatggttatgggtggcaccaggttccccagctacctctctccccatgttttagataaattaacactgcctggagtcacgtgtctctttccctgcagagccccaagaccagggtcaggcatggggaggtactccagggatgccggtgacctctctgggaaggctgtagtctattctctgttagggaataacttagagtacaaacagataagctttcagacaggctttgacaatctttaagcccccatcatttggacatgctaatagcttgatttgtcccccgggcagccaacctgtgctctcagcctcgggaccagactgcccaaaggtactgctgcttggcgctctcagtatggaatggtacttggcagggacacccataggcccggcactgcagctggaacttgcttctgcctcattgcttcatgcccgacctagagcccggggcttgtctcctaccccagccctgcctcctcctccgggcagatgccagattgcttgacagaacggtggagactcggatttgcccaccagtcctgaggcagctcacgggtgccccttcctctcttgtctttgcttttctgaatcccccaccaatgtgcctcagctgctgtgctatgcggcaatagcatttcttggtgaaggggctggttcccattgcaaagcccccctccccccaacagttacattctgcagtgccaagggatagggccatgtgactggaaggtcatccttggaagaccatataaggcacagtttgtacacttctgtccaaaccagaagcatccttcccaatgaaccacaaatgatcatgtctgacatccacctttggtcccaaggccttagctggggaaatgaagcaggcttctctttccatccctaccttgcagggtcccaaaagatgcccagcatctggaacccacttgctattgagaccccctgttagctgagcacatgccaactcattcttagacccagggggctcccgtgtctcccccacttcctcctgagttagatctctttcttgttccccctcatccttcctaaggggaggggcagtggtctaggtatgaattccatgcagagaattttagctatgttctcaagtccagagagagccgcgggcctgggcttcatttatattgagatggtttgcatacttttgtaatgaaggggtacctgcagtaggaagttttggggttttttgtttttgtttggttttggttttgtttttcttaaatagtctcttatgggtagctggattctctgccatttgtaatttttcctctgattccaattagcaaaacttccctttttatatgagttgattcttattgtgtatgtaaactgcccctggccacttggctagatttcttatcttcttttaaacattctgttccacagtttaagaaaccagtccctttggtgtgtgaatctgtcacctgtggagggttgggcagggtgggatgggacgggaactatgtggcatgcgtatgagttgaaatcccacttttgtgaggacacggtatgccagtttcccatggaagagacgcctctggcctgttgttcttgtaaaggtattcttaaggggacatatgttttgattctttcccactcactgggttcaattagatattaaaaggctgcttttc

SEQ ID NO: 222 - DNA, 2661 bp, Human
gcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaaaaaaaaaaaaaaaaaa

SEQ ID NO: 223 - DNA, 326 bp, Rat
tttttttttttttttttgacgctgatggcttatgccacgcaaatttatttacaagaatagcagtttttatgtggcttgccgaggggaaatgggacagtcagtggaaagctgttgtacaagaggatccagtcagcacgaagctaatcacacaccattgcctaagatacagggtagcaagtgtatcacagacagattttatagtggcattgggtctaataaccacagctccttgtggggaggagttgggtccaaaggtcatttgataaaacccacagtttccccaaggccctggccccgggttactactgactttgccaggggtattc

SEQ ID NO: 224 - DNA, 321 bp, Rat
tttttttttttttttttggccagatcagaaggtttttattctttatcataaatgtcagagataaaccctcttctgactgcacaaagaacatttctccatgtggaaacagatcagttggaatagggctcaggaggtcagaagcatcaagaccatccatttcagggttacctctaggggttactcacacagaatacagtaacaatgtccagccttaagtcctgcaaaatcacaggattcaaactctggttgtaagataaaattatagtgccaggctacaacttaataacaacagtaaacagtcacaaatgcccaagcggtaca

SEQ ID NO: 225 - DNA, 2785 bp, Rat
gagactccggcggatgtcctggggcaaacagtctggctctgcttgaagacagattctcattagagtcggagagaagcacttgtcccacaactctgcaagcgaggagtcagggcaacaaggagagagaattctgagaagagaggaaaaagcaaagcagcaggagagctggaggaaaggggagcagaggaaccaacaaaccagcaatccgcagctaaccagttaagcccagctctctagctgggggcagagaccagatcctgcaagcatcagagctcgaggacatgcccaccgttgcttccccactgcctctcaccaccgtcggttccgagaacagcagctccatctacgactacgactacttagatgatatgaccatcttggtttgcaggaaggacgaggtcctgtcctttggaagagtctttctgccggtcgtctacagcctgatcttcgtgctgggcttggctggaaacctcctcctcctggtggtgttgctccactctgcacctcgaagacggacgatggagctttacctgctgaacctggccgtctccaacctcttgtttgtagtgactatgcccttctgggccatctctgtggcctggcattgggtttttggtagtttcctgtgcaaggtgataagcactctctactctattaacttttactgtggtatcttcttcatcacctgcatgagcctggacaaatacctggagattgtccacgctcagcctctccacagaccgaaggcccagttcaggaacctgcttctcattgtcatggtgtggatcacatccctggccatctctgtcccagaaatggtctttgtgcagatccaccagaccttagatggtgtgtggcactgctatgcggattttggcggacatgcgaccatttggaagctgtacctgcgcttccagctgaaccttctggggtttctcctcccactcttggccatgatcttcttttactcccgcatcggttgcgttctggtcaggctgaggccgccaggccagggccgggctctgaggatggccgcggccctggtgatagttttcttcatgctgtggttcccatataacctcaccttgtttctgcactcgttgctggacctgcatgtctttgggaactgtgagatcagccaccgtctggactatacgttgcaggtgacagagagcctggccttctcccactgctgcttcaccccggtcctctacgccttctgcagtcaccgcttccgccggtacctgaaggcatttctgtctgtgatgttgagatggcaccaggcacctggcaccccttcctctaaccattctgagagcagcagggttactgcccaggaagacgtggtcagcatgaatgaccttggggagaggcagtctgaggactcccttaacaagggggagatggggaatacttaggcccgagtgatcagccacggtctgggaacagcactgctctctctgagggacagcgtgactgtgctgctcgccccagtggttcccaaccaccagcaggccttactcattactgtctcttcctccttctgcttcctggaccccatcctctctgctgaaccacttcagctcttcactgatctccctccacttccaccccagcgcttctgtggcttcctggccctcagcagccaatgaggtcactccactcttagccttcagaccttcaagggccatgtgatcattctgtgactttatctccaccgtactccctcctggtctctgggttcagggcacactggcttccactcgtttctgaagcattccaggttcactccagtagggagagttcagctatgccatctctctggacatcttcttcgccggcctttctccttgggaagagtttggctcattcctttacttcctggagtcatggctcagatctcaccttgttggtgaggaaggaggcactgtgcccaccctgctcaatgccctgtctatacactgatgctcatgtgcttctgcacacacaatattttcactctgtacagggatttctcctgtcgtgctccctgcagactgcctcgagcccacccacgcaggtgagctgcagagtaaggctctcggtgaacagctccctgctctcctcagactcctaccacagaagcttgtgtgtggaaagcctttggaaagctgctgtggaatgtgagttagcactgtgcatttctggggacagtcacaggttctccatcctccagggcccctttctctgtagctcagacaggaggatactttctgcccttgtgtgaggtctagccagtgaatgacccggacgtgtgcatcccgcaggaggaaggttgggaccatctcagctctggtcttggggactatcagtcaagttcaaagttttagactttacaaaacacatgccagtgagcaggcatccccttaaaacatcctgctgagaacactaggtatccacatgtagaagattaaagctagattcctgtctctcatctgatacaaagatcagctaaaattggatcaaggactctaacatatcacctgaagcctcgaaaccatcagagaaaaacacaggggaaacaactaaaaacatcatcagaagcaaggtctttctgagcagagacccccatagccagggaatactcagatcacatgaaattagagtctccgtggtacagagacagggtcagaatgaagagactgtttacagacaacttggccagctttcacctcacggggcccaatattcaaattgtacaggggacaaaaatgttgaataatccaattaaaaaaatgggtaagtg

SEQ ID NO: 226 - DNA, 198 bp, Rat
ggcatccccttaaaacatcctgctgagaacactaggtatccacatgtagaagattaaagctagattcctgtctctcatctgatacaaagatcagctaaaattggatcaaggactctaacatatcacctgaagcctcgaaaccatcagagaaaaacacaggggaaacaactaaaaacatcatcagaagcaaggtctttc

SEQ ID NO: 227 - DNA, 739 bp, Rat
cggacgcgtgggcgaggaggttggagagtttttttctgggacccaagcaaaggcatccacgctgctgctaagctgaaattgaagctcacacatcctggaaaatgctagcacccataccagaacccaagcctggagacctgattgagattttccgccctatgtacagacactgggccatctatgttggtgatggatacgtgatccacctggctcctccaagtgaagtcgcaggagctggggcagccagcatcatgtctgctttgactgacaaggccatagtgaagaaagaactgctgtgccatgtggccgggaaggacaagtaccaagtcaataacaaacatgacgaggagtacaccccactgcctctgagcaagatcatccagcgggctgagagactggtggggcaggaggtgctctacaggctgaccagcgagaactgtgagcactttgtgaatgaactacgctatggagttcctcggagtgatcaggtcagagatgcggtcaaggcggtaggcatcgctggagtgggcttggcggctttgggcctcgttggagtcatgctctccagaaacaagaaacagaagcaatgagctgaatgactgcccagtttttgggctcttcttttgctagagggtttggagtttgatttatagattctattgctttataattaggtttattttcacaacatacaataaaccacaagaaaggaatttttgtgaggaaaaaaaaaaaaaaa

SEQ ID NO: 228 - DNA, 676 bp, Human
acatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagc

SEQ ID NO: 229 - DNA, 315 bp, Rat
ttttaaagaagaaacagtttattgggcacttacattttcaggcattaagtccatgaacattatcatgggagcgtaacagcaggcaggcagatgacactggaacaagacttgagagcttacagtcttatctataattaggagacagagaaagagagagacacagagacagagagcagaacacatgcacactgggaatggtgtggccttttaaatcctcaaagcccaccccaatcccagcaagtaccaactgtaagcttcagggaagcggggtcttattgatcccttacccatccatgatggggatgctgacgggcc

SEQ ID NO: 230 - DNA, 293 bp, Rat
gttagcctcctgtttactgggattgcagaagtatgtaactgaatatgttattttcttccatcctcacaatatagcctaagtcaattgtgatcctcctaccttggtaccctgatagttataggcacaggacaccatgcatgctttagctttcctgatgctgttttgtcagaatggaattttttccagaagactgtatttacgtataaaaatatatccaaaccagatggcttttaagactgaccttgacaacagagcataccatatgagaagcaatcaataaatgctaatatttg

SEQ ID NO: 231 - DNA, 336 bp, Rat
aagccccaagttccatcccaagtagcacatataaactaggcacggtggtacatgtctgtaatcctagcatgtgggaggtagagtcatagcaacatagcaagttggggatcatactaggctatatgagactgtctcaaaaatattacaaaacaggatggttctgggacacagaaactgctttcttcaattaagttcttcagtctaaactactaagagcgcctggccacaactactctgaaggtcacctgcacttcacttccagggaactactacttacaaagcattcgaaaggaagccaggctaaggcaatagctacacaaaagagggctgctttca

SEQ ID NO: 232 - DNA, 3028 bp, Rat
cgagcaaagagagttcgaataaaggaggtggacggatggaacggggctgggcgggcggacagtgccggcgtccgcggctggtatggtgctggcggcggcggtcgctgcctgcgttctgaagcccgcgaggagccacaatggagacgccgccactgcctcccgcatgcacaaagcagggtcatcagaagcccctcgattcaaaagacgagaatcctgagaaacattgcccactgacggtgaacccctggcacatgaagaaagcctttaaagtcatgaacgaactcagaagtcaaaatctgctgtgtgacgtcacgattgtggcagaagacatggagatccctgctcaccgcgtggtgctggcggcctgcagtccgtacttccacgccatgtttacaggtgagatgagcgagagccgagcaaagagagttcgaataaaggaggtggacggctggaccctgaggatgctggtcgattacgtttacacggcagagattcaggtcacagaggagaacgtgcaggtcctcctcccagcagctggcctgctacagttacaggatgtgaagaagacatgctgtgaatttttagaatcccagcttcaccctgtcaactgcttaggaatccgggcttttgctgatatgcatgcatgcacagacctcctgaataaggccaacacgtatgcagaacaacattttgcagatgtcgtacttagtgaagagtttcttaacctcggcatcgagcaggtgtgcagcttaatctccagtgataaactcaccatttcctccgaggagaaggtatttgaagcagtcatcgcctgggtaaaccacgataaggacgtaagacaggagttcatggctcggctcatggagcatgtccgattacctctgcttcctcgggagtacttggtgcagcgggttgaagaggaagcattggtgaagaacagcagtgcgtgcaaagattacctcattgaagccatgaagtaccacctgctgccgacagagcagcgcatgttaatgaagagcgtgcggacccgcctgaggacgcccatgaaccttcccaaattgatggtggtggtcgggggccaggcaccaaaggctatccgaagtgtggaatgctacgacttcaaagaagaacggtggcaccaggtggcagagctgccttccaggaggtgcagggcagggatggtctatatggctgggctggtctttgctgttggtggcttcaatggctcactaagagttcgcactgtagattcctatgaccccgtgaaagaccagtggaccagcgtggcgaacatgcgagaccgaagaagcacacttggagccgcggtgctgaatgggctgctgtacgccgtggggggctttgacggcagcacaggtctatcgtctgtggaagcatacaacataaaatctaatgagtggtttcatgtcgccccaatgaacacgaggaggagcagtgtgggtgttggcgttgttggaggtttgctctatgccgtggggggttacgatggagcatcgcgccagtgtcttagcacagtagaatgctataatgctactgcaaacgagtggacttacatagcagaaatgagcaccagacggagcggagcaggtgttggtgtgttaaacaacttattatatgctgtaggaggtcatgatggtcctttagtacgaaaaagtgttgaagtatatgaccccaccacaaatgcctggagacaggttgcagatatgaacatgtgcagaagaaatgcaggtgtctgtgcagttaatggtctgttgtatgttgtcggaggagatgatggttcctgtaacttggcgtcggtagagtattataaccccaccacggataaatggacagttgtgtcctcttgtatgagcacggggagaagctacgcaggggtcacagttattgataaaccgttatgagcctgaaggacattttcagcgtatcattccatgagaaccaggcgtccacaagtatttctgaagggactgagcgcctggcctctccacttgtagccgcactttacgtctcagcagaagatgagaccatctgccttcagaggcctcggatactgaagattatttttggtagaagcactgtgtaggctttctctgcaccgagcagcagctgactgactttacaagagacctagactgcagtccctccactgtggtctttaggcaacagtcgctttcataaaaactagttcttatcagcctcgaatgactatggattattttgtgaaagagaataaagttaacgtgtgttcttgtaaaattaagttttatctttattctttctcctgaaaaatctcctgggaacagagaatctttggagcagattaaaatctatgtaagtatatgacactgttgaggggtgaaactgctggcttttataagtatctttgattacatgactataataaattgtgtgcatataaatgtgtgtctatatgctttcctttaaatatgtttgaaaagatgtttgattatctatttataattggcacagtactttgaattatgccagtactacattgtaaaacagagttgtattttttgatatttaacaatgctgaacactttaaaaaacgccacttctgaggaatgaatgaacatggcgtaacacactttaatatgtgtgatgccaaacttttttaaataaaatataaattatgcttatttattatttttttctttagtttaatcttgatcatgttttggtgtgtgtttttaattttttttcttaaagtaacacttttggcatgaacatacctgcaggttttttgatgaatataatgaatgtgtggaattcaactgaatttgcatggtcttaagaattttttctgtgtgtataaatttagctgctattaatggaagagaaagctttctgtgactaatcatgtgtattgagcagatagtttttctgagatcttcgattaatctctttaaagatgaccaacatgtgtctttcttgaattatctttgaataaaagtttgtatattatttgtttcacaaaaaaaaaaaaaaa

SEQ ID NO: 233 - DNA, 3144 bp, Human
agcggagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccacggctggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccgggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctagtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattaaaaaaaaaaaaaaaaaaaaaaaaaaaaaaaaaaaaaaaaaccaaaaaaaaaaattaaaaaaaaaaaaaaa

SEQ ID NO: 234 - DNA, 1334 bp, Rat
caccacctacctaacacaggcgactctgagcactctctctctgggactgggcagagcggcaaacggtcacctctcagacagcctttgacagacaggaggttctacataccatgggagccagcctgctgtaagatggccaccctgagcaatcacaaccagcttgatctttctaatggctcacacccagaggaatacaaaatcgcagccctagtcttctacagctgcatcttcctgattgggctgtttgttaatgtcactgcgttgtgggttttcagctgtacgaccaagaaaagaaccacagtgaccatctacatgatgaacgttgcactactggacctcgtatttatactcagtctgccctttcggatgttttactatgcaaaaggcgagtggccatttggagagtacttctgccacattcttggggccctggtggtgttttacccaagcctcgctctgtggcttcttgctttcattagtgctgacagatacatggccatcgtacagccaaaatatgccaaggagctgaagaacaccggcaaggccgtgcttgcgtgtgggggggtctgggtaatgaccctgaccaccactgtccccctgctactgctctacgaagacccagacaaggcctcctccccggccacctgcctgaagatctccgacatcacccacttaaaagctgtcaacgtgctcaacttcacgcgactcatatttttcttcctgatccctttgttcatcatgatcgggtgctacgtggtcatcattcacagtctcctccgagggcagacgtctaagctgaagcccaaggtcaaggagaagtccatacggatcatcatgaccctcctgctgcaggtgctcgtctgcttcgtgcccttccacatctgctttgccgtcctgatgctacaaggacaggagaacagctatagcccctggggagccttcaccaccttcctcatgaacctcagcacctgtctcgatgtagtcctctactacatcgtttccaaacagttccaggctcgagtcatcagcgtcatgctgtaccgcaattaccttcgcagtgttcgcagaaaaagtgtccgatcgggcagtttacggtcacttagcaacatgaacagtgagatgctttgagtcagagcaagctgccagtcttcagtctctttaaaattcttttcctatctactttcgggtgaaccagcattctacactatccagtcccttctctaacaaagagaaataataatgatgaactttaaaaacttctgcggtattctgtgtattctagccacatgattaaaaactgagtattctgaaaaaaaaaaaaaaaaaaaaaaaaa

SEQ ID NO: 235 - DNA, 1408 bp, Rat
gaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaaaaaaaaaaaaa

SEQ ID NO: 236 - DNA, 242 bp, Rat
  misc_feature (228)..(228): n=a,c,t or g
gccattctgttttgcagctttaatggcataatagacaatcattacactaaacattcattggttgccttttataaagctcatgctgttgtgtttcctaagatagtgcagaaaaggcccatttcaggagtggtgaatgtgtttacagatgggtccaaaactggatgtggagcctatcttattgaatctcaacaactggttcttaggcaatatcaacctggaacaccccanttggtagagttaca

SEQ ID NO: 237 - DNA, 1802 bp, Rat
gactcattgcatcttcctgccaccccgggcagtgtctgggccctccgctccccctccctccacctgccccttccacccaccaccaccagcccactggagcccagctcaggcggaggaaagaccaagcctagagacatgggagttcgaggagcactccatcttctacttgtgtgcctgagcccagcactgttgtctgctgtaaggatcaacggggatggccaggaggtcatgtacctggcagaaggtgacaatgtgaggctaggctgtccctacctcctggatcctgaggatttgggtaccaacagtctggacattgagtggatgcaagtcaactcagagccctcacacagggagaatgtttttcttacttatcaagacaagaggataggtcatggcaacctcccccatctgcagcagagggtccgctttgcagcctcagaccccagccagtacgatgcctccatcaacctcatgaacctgcaggtatctgacacagcaacctatgagtgccgggtgaagaagaccaccatggccaccaggaaggtcattgtcactgtccaagcacgtcctgcggtgcccatgtgttggacggaaggccacatgtcaaagggcaacgatgtggtgctgaagtgctttgccaacggaggctctcagcccctctcctacaagtgggccaagatcagtgggcacagtcacccctaccgagctggggcttaccactcacagcacagcttccactctgagctttcttaccaagagtcattccacagcaccatcaaccaaggcctgggcaacggagacctgctgttgaagggcatcaacgcagacgacgatgggctgtatcagtgcacagtggccaaccatgtgggctacagcgtctgtgtggtagaggtgaaagtctcagactcccagcgagtaggcatgatcgttggagcagtgctgggctctttgctcatgctggcctgcctggcactaggcatctgggggctcatctgctgctgctgcggaggcggcggggccggtggtgcccgaggtgccttcggctacggggtcggcggcggggtcggcggaggggcctgcggcgacttggctagtgagatcagagtggacgccgaggcgcccgggtgtaaggccagcgggcgcggcagccgcgtcacccacctcctggggtacccggcgcagaacgtcagccgctccaggcgccgcaagtacgcgcctccgccctgcggcggccccgagcacgtggccctagtgccccgcaccgcctccgcctcctgcgaagcgggtccctcccccgtctacatcaaggtcaagagcgcggagccggccgactgcgccgactgtgcccaggtcgagcagcgctcgtgcaaggacggcctcttagtgtgagcgcacagcaccgggctgcgccccggctgggaggtggttcgggggctctctgcccgcagctggggacaggttcgggccagcagacctggctctctcattggccacctagcggtggtaaggaaatttccctctgagaagccaagccgggcagaccctcctcccctgtagtgggaggagaggcgggggagacagaaaacagttcagagctctccctcacccctggtttccagggagaggaagggagaggagagctgtcggtatcccagaaccgcagaggtacaacccagatgtccccagccaaggcgagggccccccagccctgggtaggtggatgtcagggctgaattgctctgtgtgtgagatctgagctccaaggcaacagtgttagcacaataaagaaacttaaagactgg

SEQ ID NO: 238 - DNA, 2662 bp, Rat
atctttgatgagggcagagctcacgtgcattgaagaagaaacctcggggaggtctggagctgtctttccttccctccctacccggcggctcctccactcttgctacctgcagggatcagcggacagcatcctccggagaagacaaggtggttgaccagattgacaccctgacctctgatctacagctggaagatgagatgaccgacagctccaaaacagacactctgaacagcagctccagtgggacaacagcctccagcatagagaagatcaaagaacaggccaatgctcccctcattaaacctccagcacacccgtctgctatcctgactgtcctgagaaagccaaaccctccaccgcctcctccaaggttgacacccgtgaggtgtgaagagcctcagagagtggtgccgactgccaaccctgtaaagaccaatggcacccttctgcggaatggaggcttagcggggaggcccaacaaaattccaaatggagacatctgctgcatacccaacagtaacttggacaaggctccgttgcagtctctgatgcacagacctgaaaaggacaggagtcctcaggcagggcctcgggaacgagttcggtttaatgaaaaagtacaataccatggctattgtcctgactgtgagagccggtataacataaagaatagggaggtccatttacacagtgaaccagtccatccacctggaaagatcccacaccaaggacctctgctccatcctccacctcatctccccaatttcccattagaaaatgggggactgggaataagccacagtaacagtttcccccctcccacacctgcaaccgtgcctcctcccgctgcaccaaaaccacagaagaccatcctgaggaaatccaccactaccacagtgtgatatctgccatttaagaaaacgttctgtttgtttttaattttctatatgataaacgtaaaataataagtaatgagcactttctactcaagcaataaaaagcccaaatatattaatctgcattcaacaaagtggcataaaaaatcacgtggtaagtatgcagagtagcgcctctgtcctggacgtacattgttttctatgttccatcatcagaaactgcggaaaattgagaaagtatgaatgaattttatttttttgtgattgacctaaaacaaactgtgaccttctgattccaagtattttggtctattataagagctgggatgtcagatattttgatttgttgataaagccagggcaactcattccattcatgcctatctcatctatgcattgatgatgtcatagttctccctttgatctaatgctttttaataagaattttaataccgaaggactattttattatttttctaaagatgtttgtcaatagttttgcatcatgaaatgctgaggacactacaaaaaagtttattttctatactatacaatttgaaacatatgttcaactatatgtataataaaatattttgagctttggaaatatgtcaataaataatagtaaataatgagaaagcctaatgttcctgaggattaaaatgaagtgaaaattacttttaactccctgttaacattcactgaaatggaaagccagtccccaagagtttgaataaggtgatactgattggatatcacattcgtagagtaaatatcacaacctattcggtaagtatattcttacaacaatttcttattatacacctccattatggtactcctagaatcagcgatgaaagtctttgatgttgtcatgccttctcacaggactcattgtagataattacactggaaggttggaatttttgccttcagtttaccagagcaagctcaaattccctgaaagaacacagatttataggacggaagtttcaggtatctctagtcacagggtatgttcaggaactgcctttccctttttctcttctaagttgaagggtgccaggaatttttgatgtcccatatgagaatctcttctctctaccttcaaacccaaggctttctcctaagtaatgtttgccaacttaagaaacttagccaacagatagatcagtcaggtcctagatgcactgatttggactgatgtgatttttttgccttggagataaaaattatttatctctcaagaattagtgtgaggtaaagtgcctgcagggagagggccaggaatcttttatgaggtaacagtggagagcaactctaggtgggaattggtatactgtgtacattgagaccatgggtgaccttttaaaatatgttccttttaattttaaaaatttaacctttgctgctaaagaaggtagtcttatgatttagtcttatgaatactttttgaaacagcttttttattgaaatatgacaatgtattttggggaagactatacaaaaaaaaccatagcatttattatttaaattaatgaacaaaataaatgtgagacagagaatgtcctgttaaaattttgctcggtgtgctattttatctttctgtgttgtacatgaggggaatgtaagcttaatgatccaatatttgggaaagatataagacagtaatgaataaaggccataatctagtatttattaactgtacgatgagtgtatttaagtgatatgacgcaggaaaataaatgattgaattgttgaatacc

SEQ ID NO: 239 - DNA, 273 bp, Rat
  misc_feature (31)..(35): n=a,c,t or g
  misc_feature (37)..(48): n=a,c,t or g
  misc_feature (50)..(58): n=a,c,t or g
  misc_feature (60)..(62): n=a,c,t or g
  misc_feature (64)..(64): n=a,c,t or g
  misc_feature (66)..(66): n=a,c,t or g
  misc_feature (68)..(68): n=a,c,t or g
  misc_feature (70)..(70): n=a,c,t or g
  misc_feature (75)..(75): n=a,c,t or g
  misc_feature (79)..(79): n=a,c,t or g
  misc_feature (84)..(84): n=a,c,t or g
  misc_feature (86)..(86): n=a,c,t or g
  misc_feature (89)..(89): n=a,c,t or g
  misc_feature (91)..(91): n=a,c,t or g
  misc_feature (94)..(94): n=a,c,t or g
  misc_feature (96)..(96): n=a,c,t or g
  misc_feature (98)..(98): n=a,c,t or g
  misc_feature (100)..(100): n=a,c,t or g
  misc_feature (102)..(102): n=a,c,t or g
  misc_feature (107)..(107): n=a,c,t or g
  misc_feature (110)..(110): n=a,c,t or g
  misc_feature (114)..(114): n=a,c,t or g
  misc_feature (118)..(118): n=a,c,t or g
  misc_feature (141)..(141): n=a,c,t or g
  misc_feature (236)..(236): n=a,c,t or g
ggtaaggaaatttccctctgagaagccaagnnnnncnnnnnnnnnnnncnnnnnnnnngnnnanangngnggganacanaaaananttnanagntntncntnacccntgntttncagngagaggaagggagaggagagctntcggtatcccagaaccgcagaggtacaacccagatgtccccagccaaggcgagggccccccagccctgggtaggtggatgtcagggctgaattgntctgtgtgtgagatctgagctccaaggcaacagtgtt

SEQ ID NO: 240 - DNA, 1798 bp, Human
gccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggagatgaagtcccactctgttgcccaggctagagtgcaatggcacaatctgggctcactgcaacctctgcctcccaggttcaagctattctcctgcctcagcctgcctcagtgcgccactacgcctgggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccatctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaaaaaaaaaaaaaaaaaaaaaaaaaaaaaaaaaaaa

SEQ ID NO: 241 - DNA, 2165 bp, Rat
gcccctcccttctgctggccgcgcggagtgggagccccaggtgcaacggagaagccgggttcacgggtccaggaactggtgaccctttcctaccccccatccccccaccacagtgctacccaccgcgttctccccgccgccgcgtggcaatgagcagcccggtcagcaagccgcctcccgagctcctcgagcctaacccagggaagtcctacggcattatggagattgccatcattgcagctgtgatcactgctgtggccttggtcctggtctgcctcctctttctcatgcttcgctacctgtacaggcacaagggtacctaccacaccaatgaggccaaaggcacagagtttgcagagagtgctgatgcagccctgcaaagtgaccctgccctccaggatgctggggacaccagcaagaaggaatactttatctgaggggtagcagacttgacatccctgcaagatgcttctggctgcaggagagaaagtacccccgctgtgtgccaccattatcagcaccaggaagcccccaagggcaccccaagactcttactgcagaacactgggtgcctgccaggaaaccgatacagatgggaggagtcaaggcccagagcactcttccagggactcagtggccacccagtggcattggcttcgcaaggaagagagaacatctggatacccaggtctccctgggcaatgcaggtatcatctcaccagcatggaagtcctcctcagtgtgcatgaggtggtctggacctgggagtgggacgtatagaagtgggacatctagaagctgcctggagatgatggcatcaagtgtcagtcattgacatttgggaagaccagcaaatgccagagctaaaaaagcttcttcatccatctcccatgcagctcaagacgattacaaataagtttgaaatgtgactgagcccgttctatatcaaacggcactactctaagtgtctgggaaatgtaaatgccacccattgctggcttttctctggtagaacactgtgtctgtgtgcagcctgcaaggattgtctagctctgtccaaagaagagggggaagggtgacctttcccctcgccagtcccagctacaggaaacaaatggaaagaggatacacagtaaccaggccactggctgaagcactgatttcttgataaacaattttaaaaagagagttgtgctcaacaaccatgagtgaactcggtcatgccagagtcccagtgcaaatgcctctgtgttagaagagactgaagatccccagacctgggtttggctcccggctcctctttattggtcttaggaccttcagccatgtgtttgacctctccagctttaacgttggcctttctcaagtggaaatgatgctgagttgccttacctctggctcctgactcccagcattgtgggcagggacagaagcatcagatgctagccattcgctgccttacagcgtcactaacacactggatgcgtggcttgcctgcctgtgttggccaatagaattcatctttgcaccacctctaaaagccccctgagaagtcactaatttagatttaataacagggaggaaatgaatgaattagccaaccccttgcaggtaagattgccagcggctctgcagtttctctaaggccagcattgctgtattgaaagaccgcccctcaggagccccctcagctgtgctatctccacctagcagccagcaaaaaaggagcctgagacactaatgaggatgcaagcttggtcaagtatggccaccagccaaaggagctatgattcctccgaatgttgtagggaagagaagcagtgattcagttataacaagggccagacgaccccagaatggaggatgtctgtgtcctcatctgtgaagtaaaaggctggccatagttgacacccattaatctagagagaccttatctgaaaccctagcggatgcttgaaacccaaggcagtattaaacccccttgtattcggcttttctgcacatacttatgttgagatttaatttataaattaggcacagtaagaaattaactgcagtaactaacagcacaatggtataactagaactataaagctgtaataaaagattcttgagaccatgaaaaaaaaaaaaaaaaaaaaaaaaaaaaaaaaaaaaaaaaaaaa

SEQ ID NO: 242 - DNA, 1819 bp, Human
gcgcgaccctcccccggcccggcctggcccggcctggccagtccccgcggtctctgcccgggctgacgcccaggaatgtggtcgacgagaagccccaacagcacggcgtggcctctcagcctcggaagtctccaaggacccccatgaaacacctgcatttcctgtcatgattttgaggctgaaatcatcttcctcctcccagaacacctaggtgttctagtctgaagccatcctcactctcaactcccctccttcgagccctcaccctgtgcctgaattcttccttctttgctgggacagatggacaggaggaagacaggaagtggggaaccccttcaacaactcctatggcagaggggagccataggagatgggccgggaaatgtaaagaccagcccacgcaggaaaaaaagagaactttttagcacagtgtcatctgaaaatgcaagagaagagaggctcttggtggcaacagaggagtgtgacttccatcctcagggctagcacctgacccctgctctccgtccacatctgaaaaataccactggccctgagaatccattgcaactgaggttctgcaccccaacagctgcactcaagctgccaactgaagcagagagcactgcccgcactgcagggttgtgcctgtgtgccccgctgcctccaggggtggctgccttctgccagagaatggacagctgacatcctgaggacatagagagttagtaggaatgactgtagccaatggcaaatcccatggatgaaaagccactcccaactccacaaagatgagcatagtgaaggctgcagtttagttggttcgtggttccccagaaggctttcaaacattcagcagttgtcattcagtgccaggcacccagtctaatgctgagtatagagttgtgagcaagacaagcctgaacgtgtggagcttcctgtctgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgaaaaaaaaaaaaaaa

SEQ ID NO: 243 - DNA, 2947 bp, Rat
tgctgctctgagtgggcccggctgctgggccgccggctccggcgcatgggcctcctccgaggcggagctgcgtgcgctcgggccatggcgcgcctgggcgcgttgcgctcgcactactgcgcgctgctgctggccgcggcgctggcggtgtgcgccttctactacctgggctcaggccgcttgcccttctccagcgccaccaagaggctgaaggaggcccgcgccggggccgccgcgcccacgccgcccgcacccgagctggcccggggctccgcggcgccgggcttcggggccaaggccaagagcctggagggcggcgtggtggtcccggtggactaccacctgctgatgatgttcaccaaggcggagcacaacgcgccgctgcaggccaaggctcgggtggcgctgagctccctgctgcgcctcgccaagttcgaggcgcacgaggtgcttaacctccacttcgtgagcgaagaggccagccgcgaggtggccaaggccctgctgcgggagctcctgccgcccgccgccggcttcaagtgcaaggtcatcttccatgatgttgctgtgctgacagataagctcttccccgtcgtggaggccatgcagaagtacttcagtgctggctcggggacctactacagcgactccatcttcttcctctcggttgccatgcaccagatcatgcccaaagagatcccgaggatcatccagctggaccttgacctgaagtataagaccaacatccgagagctgtttgaggagttcgacaacttcctgccaggcgctgttatcggcatagccagagagatgcagcctgtgtacaggcacacgttctggcagttccgccatgagaaccccaagaccagagttggggaccctccgcctgaaggactccctggcttcaacagtggagtgatgttgctgaacctggaggccatgcgccagtctccgctctacagccatctgctggaaccttcgtgggtacagcagcttgctgacaagtaccacttccggggccacctgggggaccaggacttcttcaccatgattggcatggagcaccctgaactcttccatgtgctggactgcacctggaaccggcagctgtgcacctggtggagggaccatggctacagcgatgtcttccaggcatacttccgctgtgagggccacgtcaagatctaccatgggaactgcaacacacccatcccagaggactaggcaccagctcacccgcgatgctggtggggctcccgggcctggggaagaaagagagactctgctaggacactctttaggggtgaggtgctgcagacctcccagctggctggctcctatccagccaatatccaaagaagcttagctgagccttgctgctgctcgagccgttttcctccagggcagcccgaaggactgacacgggtgtcttccaggaggtggtcgaagatacggaaggaaggagaattgcacccttgtccacacggaatcaaaacccttgtaaagaactggctttgctagaccaactaagcatttcaagcggcaggctctaatgcttggtgagagaagaggtgggtgctactgtggctcccagtgagcactgaatgcctagtcagggttttaacaagcagcccagggcttgagcctccaaaggaatgccacagtcccacatcctttcccaggaggctttgtacctcctccagatgttcatgttgcttggtgctggcttcaagagcagcacctcattagataaagactgagcacataaaaaaaacccttactatagtgtccagagctcttatccctcctctatcccagaaccccaccttctcttgtctgtctacctgctccaggtgacctgacttctactaaagaatcaaacccgtcatccaaggacagaggttggccatgccggggcatgcactagattcactccaaggaattcactccaagtctaaagtactgggtcacaagtacaattgggggggcttgggaaagggtggcctcctgctctcattgtagtctctggagaagaaagaaaaccaaactcgtaattgtccactgtgtcatgccagcccctaccccttcccagaagtgagtaccatttctctgtgtgcttgagacgggctttgtgagtcagctgcccacatgaagccccacaggccgtgtctgcacagtccagctcatgtcctcaggcaagaaatgggagattcttattgtatatagtcagtaccatgagcgacagacactagctgatgaatagactttgagaactcttgagtcacggtgtttgttctctggccagtgttcagggctctggatgggcagtaggatcagcatcaagcagaaggcctaagaggcccaaccggcaggcctgcacgtgggcgcagtgggtggtaggtactgccctgtttgcttccaggtgcagaactatctcgttctagctcttagcaggctcatcccctgccgggaacaagctcagaagtctctggctccttagcccagacctcccagttccattcatgctggtgagtggcacactccttcactggccctctgccgggcccagttcctctgttctccttgctacttgatttcctattcatagtgtctggttattagatgcctgcgtgcgccaggcatcgtcttcaggatttatatgtgccctagataatattcatgaaaacctcatccagttcactccagctctaaaactgatggatgaaaacagagacacggacaggttctctgctgtgctgtttactgaagctttttactgtgcaaaaatgttggaaacagcttaaaatgttggctagagaagcagataaataatgcatactgcaaccgtatggtggaatatatcgcaaatcatttgaaggaatatttaatgtaccaggaaatgcttatgctagtgagtaaagaatacacaataaaaaaaaaaaaaaaa

SEQ ID NO: 244 - DNA, 2820 bp, Human
ctggcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccctgccttgcccctggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacgaggacatgcaggagaactgtcgggaccaggaagactcattccaaaaaggagcccaggccgggcacagtcgtcaagcctgtaatcccaacactttgggagaccgaggtcgggggatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcgtttcttttgatggggcctcctgtacgtaggctgcagacgtgaaagccccaggggtccatttgtatcaattttcatcttgttttgtttgttttgatttcatttacgtttttctttttcccatgagtgaggatagctaataaatcatctttgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 245 - DNA, 2360 bp, Rat
tggaaagagctgtagagatcaatagaggtcttgtgaccccctgattcagtgctttcatcactactgacccttaaatttaactgggatataatgtcaatttaaaaattatgtgagccaagcagtggtggcgcacacctttaatcccagcactcaggaggcagaggcaggcggatttctgagttcgagaccagtctggtctacaaagtgagttccaggacagccagggctacacagagaaaccctgtctcgggaaaaataaaattatgtgggccaggtaaatgtctagaaatggaattgtaggcaaagcagggcataaggaaaaaatttaagtagatgaataaatatttttaaggcatggaggaatggcagttgcttctcttgcaggggtcccgagttctattgccagcatcacatggtggctcagaactgtgtctaattccagttccagggaatctgacaccctcttctggacttcaggagccctgcatgcatgaagtcctcatacatacatgcagacaaaacattcttaacattaaaaagtcaataaatctgaaagatagtaaggatattgaaattggcaatgttgatgttattatcacttattactgtttgcaagaaataaaaacaagtcgcaaatgcaatggtcatcagtctttgacttaaaatcaatcaagaacgacatcacaccacagcctatgtatatccacccaatgctgaagtgtctgcagtatcggcactcagaagggcagtgaattgaagcttcatactactgaacatgacgagagaaaaccctatatgagtacgtcatatgaaatagagctcatctgaagtacagagccataactgatgctttaatctcatcctctctcaggctatggtgaggtatgtaaaaacctgagatgaatagttctaggggcataagattttgtttatgtatttaggcagcactttagccgacgctaacttgcaatagactgtttggaagacagactacctggaagtcactcacagtgattgttgtaagaaattaccacatttccacattttaaattccccaaattgtatgtaatttgagttaccaataaatgtacccaccttacatgaagcaatacaatatgaggtcccagtcagtactttttaatttgtctgttactactacttcttactaaaaatgtgggggaagaattaaatattttgtttagtaaaagtatagaaccagaaattgacacttgatttttttaaaaaaacaattcactaatctttaacaaccatgttagcagctacccaggttatttgataaaggggaaacatttgaagcaaatgtcttacattagctctgaaaggcacaagaggaaaattcaaagttcacatttgaaattatgctttttcacaacttaaaattaaaccacgtaagacatgatatcttacatttttaagctttgcaaaggatgccaacatcaaaactagatttgtaattagaccttatttaatagatttttaccaatgagctgaggtgaaataaataaaactcattacacagtggtttaaagatgtctgaaattctatacttaaaatctagtcgtgaaatttaaatggtaaaggtttcaggacaaactatctgttttccagtagctttttggtgactactgattttctgaattactttttctgagaccaaataccctctgtcttagagggagaatgtgatgtgaatttgtgttgtgtacaatccgactctttccaaactggccccacaggagaccggagctgatattctcacaggcatccttgtgagaacataaagaccactgagaaatatcttctatgactaggacaaagaataacaaggaaaatgaagtatagctccggctatcaaactacttatcttttccttagaaaaggcgtacatttgtggagcttgattactttggggggatagctcataacctgcattgtgacatcctatttctgcagcatgctgtggtatgccaagcatgagtctgacgccgtgttcaccctaaaatcctcttgaatcacaaggctgacgatcttacttgaaaaccaacccgatttaccctatgtttacacaggaagggttttcccttcgatagttaatttgacttttgtcccaaattttggtgtgtcaataaaagtaaaaacaaatgtattggttttttttttccttcggggcattaattccaagtagaagcgtgtatttgtgagagatgtagcttatctccatgtttggaataggtctttgactgtgtaagccaaaagagcttgttatacattggaaccctgaggaagttatgcgctttaagacatgataaatgcggcaacagatattaaattatttgttt

SEQ ID NO: 246 - DNA, 343 bp, Rat
attcggcacgtggggcttcggagaccacgccacgccgcggccccctagctgcgtcctccactccaacatcaaggaaacaggtgagcatctctcacacgccctcatttggccaggctccccgaaagaccttcatggctcccccaaagcacggtgcttcctgacccctgatacttggggagacaccacagccgctctctcgaatgcacgtccgtgagatagtggggtggggccggatgtgtggggccttggtcctgcatcgcagccgactgggggttccagaagggagccggatggatgggtaagggtcacagggccctcaacactaataaagaatggactggta

SEQ ID NO: 247 - DNA, 3306 bp, Rat
tgttagaaggggggaaaggtggtattgcagacagtgtagccaagtggatatttaaacaggacctcagccctgaattgttgaaatgtgccaacaaagagagagatgtagaaaatccagacgaacccagagaaggtattacacgaagtttccctgaggtgtcagaggtggagatagacctaggagccgtaccagacttgctccacctggcctacgagcagttcccttgtagccttgagcttgatgtgctgcacgcccactgctgctgggagtatgtggttcagtggaacaaagacccggaggaagcctcgctttttggttagatccatagaacacttgaagcacattcttaatccacacgttcaaaatggtatcgcgctgatgatgtggaatacgttcttggtgaaaaggttttctgctgctacttacctaatggataaggttgggaaatctccaaaggataggttgtgccgaagggtgagtgagtctccctgtcaaacctacacactgtctacatagtgtctgtcttactgtaggagtgcacttgttcttactgctgaggtgatctctctggagagaacaaggaacagaaagagagtgctgctttaaggacatagttttggtttccggccgctctcatgtttccttgactagacagcagctagcccgtgacatccctccagctcagttagccttggactccagcacctcacagagatgcctgccctcccctgcaggcaggctctccatccaatctcagctcgcctcaactgagactgacccacagacactgaggctgctgatcagtagtgtcgctgttcaaaactgggacctgttctgaaatatctcaagtgttgagagacgtaaacataactgttgaagacctcattcccccagcccgtcaccacgactgaagatttctgctgtgtccttcagactggaggttgtgtgactggagctaagtggtcgtgcacacacacacacacacacacacacacacacacacacactttgtattatgtactttgaggatatggagaattgcttgcttgttggctgtaaaaagactatgcagagatgcagtggcctccttcacactggcctgctgaggggtcattgggaactatttcttgccaaaaaatttgagtctagtatttggttgtcaagtgaggattatcgttttattcagaaaatccagttcagtgccttcaagataccataaaaccagcagcccatgttggtatcttggacctttcctggttgagtttcatgtgtacatctcaccatattccatggttcgctggctagcaaacgctctggcaagttgaagactctgtctttacagtgtacagataggagatgttactgtctcccctcttgcccttggtgctagagatggaatccagattcttacgtatgctgagcataccccagcccctgagcccagaacaccctcaccccagaacattgactttgaagattgatattaataacactgatatcacactaaatgctgatataaaagtgatactaccaaacccactagcaggaatttgaacacacagtgacttcagatggtattcagtgtagaaagtcaggcagtggccatgctgagccctcctttctgcagcgcagccgttctgatgtagggacgttgtgttcctttctgaaaacaggatgtggggatgagcgacacggcgctgacatccttcctcggctcctgcctggaacttcttcagacgtcattggaggctgacattagcagggatgaagtccaggtgcccgtcctggacactgaggacgcctggctgtccgtggaaggccccatctctatagtggagctggcgctggagcagaagcctatccactacccactggtggagcaccattccgtcctgtgctccatcctgtacgcgtccatgcgcttttctctgaagagtgtgaagccactcgccctttttgacagcaagggaaagaatgcattttttaaggatttaacttcaattcagttattacctagtggggaaatggatccaaattttatttcagtaagacaacagttcttactgaaagttgtcagtgcagctgtccaggctcagcattccaaggacaaagatccctctgcagaagcagcaaacactcattggaaagacctcaactggccaggtttggctgtggacttagcccatcaccttcaagtgagcgacgatgtcattcgaaggcactatgtgggggagctgtacagccatggagctgacctcttaggagaggaggccatttttcaagttcaggacaaagaagttctggcgtctcagctgctagtgctgaccgggcaaaggctggctcacgcgcttttccacacccagacgaaggaaggcatggagctgctggccagactcccgcccacactctgcacctggctgaaggcaatgaaccctcaggatcttcagaacactggcgtgcctattgcagcaacagctaaactcgtgcataaagtgatggagctcctgccagagaagcacgggcagtacagcctcgccttacacctcatcgatgccgtggaagccatggcgactttatgacagtagcctacagtcctgtgactacatgaaccactgcatgtcatttttcatagtaagatctggaacttcggaaggttttttttttgtataataaataaatatattactttaaaatgtgcaatcctgtctaaattccccatcttcagcaaagactgaagataaactataaacacattaactatcctgtgactaatgcagatgctttattctttattttttcattcaaataagcagttttattgttaaactttggtattgttactggttataatttgcagattttgttcttagtgtagtagtctagttcctatccaaatgattccgtggggattaagtgtgttcacactgcttccatgagcacactagagatacagcccatgtccctttcaaacacacagagatgtcctcatggttggtcgtgtaccgggatgccacctggcagggagctctgggtgctaaccacttcctgtccagggtgctactgctgtcagaggagaaatggcttgagatcagcaggggaccggggaacttggggaaggacctcaagtctgttgtccttgccagacttaggaatcagaggtgtgaacaaagcagcaagatcagttattatgtaaattaaaatttactctattttgtcaagttccaaaattgtatccacatcaggtaattgtaaaaatgtattatcttgtaagacatgtttaaaaaaaaagaacaaagcaaagaaacg

SEQ ID NO: 248 - DNA, 5129 bp, Human
gcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaaaaggcaaagatactaaaaaaaaaaaaattttagtccgactttatttttcctacaagtgtttaggaaatgcttctggg

SEQ ID NO: 249 - DNA, 1900 bp, Rat
gggcagtgtgtattccgtcaccatggggctttcttttcctgccttcggactctggattcatggctctgcatgtagctgttctgtgagagcactgctcagcaggcacaggcccaccgcatacctgtaagggtaaagaggaacccgccagggcgctgacagccgcttgggagccagggagccgctgtgcactcggaagagaatggaacaccttcagaagagcacatatggaactatagttcaaggaccagaagcccactgtgtacaagaatctagctgcctgaggatcctcctggtgggcaaatctggctgcggtaaaagcgccacagggaacagcatcctccgacgaccagcattccagtccaggctcagaggccagtctgtgaccaggaccagccaggcagagacaggcacatgggaggggaggagcatcctagtggtagacacaccccccatctttgagtcaaaggcccagaaccaagacatggacaaggacatcggagactgctacctgctgtgtgccccaggaccccatgtgttgttactggtgacccagctgggacgcttcacagctgaagatgccatggctgtgaggatggtgaaggaggtctttggggtaggggtcatgaggcacatgatcgtcctcttcacccgcaaggaagacctggaagagaagtccttggaagagtttgtgacccacactgacaaccgcagcctgcgcagcctgactcaggagtgtgggaggaggtactgtgccttcaacaacagggcctctggggaggagcagcaggggcagctggcagagctcatggccctggtgaggaggctggaacaggagtgtgagggctccttccacagcaatgacctcttccttcatgctgaggcactccttagagaaggttacagtgtgcaccaggaagcctataggtgctacctggccaaggtgaggcaggaggtggagaagcagaggcgggagctggaggagcaggagggcagctggatagctaaaatgatttgcacagtcaagtcctgctggagctcccacactgcagcatgtgctcttcttattgtgcttggtttgactcttctcaccactttcattaacttgtgtattagcaggtgtaaatgagccttttttgggtgatttcttccatcatccttgtcccccaaagttccccatctcatgtcagggaacctcagtcttcaattaatttcactctcatttgattcccatggatcagacatgccagggaatcttcttttaaatacagttagattaaataaaggatgaaagaaaaatgtatttctctctttgttgaagttgtgaggatagatgatgaagcaagtagctaccattataaaggtctgggggtttgcacaaaggaagacacatggactgttgtggcagtgggtgtatcacttctagatccccacttcctacagatgtgatgtcaagaggagaaatacacaaagctgagagcagagtcatactttagtcaagtataccctgactttcatggtaccaataaagtcagaactccatcataattccaccccgagaaagataaagatggtgtgcatgaagcactgaggtgggagggccaggacatgagtggggaccaagtgaagaggttacaggagcagggtaggtcttatcccagaaaaagcagggtcagcagtcaagaatcacatgagccagaaagtctatggtcagagatacaaagggccagaggtgtgtatcttgggcttggaagattgtgtggtgagcattataggccctcaacaactcatgcaggcaaaagccactatgatacataaacctgatgagcactaagtttttgaagtacatgtaattttcatgtatgacactagaacattgttctcctgaatccttcagctatct

SEQ ID NO: 250 - DNA, 1 bp, Place holder
a

SEQ ID NO: 251 - DNA, 2775 bp, Rat
ggtgaacgtgctgccgcctatcagtcactcagtcgcctggagtcggagttgctatttctaggcttgtgcttgttgggttcgggcccccaggtaaatagccacagaaggctaccaaacaagataaataattgtctccaagtagaagaaaaccaagctccatgagtgggcatcggtcaacaaggaaacgatgtggagattctcacccagagtcccctgtgggctttgggcatatgagtactacagggtgtgtattaaataaattgtttcagttaccgacaccaccactgtcaagacaccagttaaaacggctagaagaacacaggtatcagagtgctggacggtcccttctcgagcccttaatgcaaggatactgggaatggctagttggaagagtaccctcatggattgccccaaatctcatcaccatcattggactatcaataaatatctgtacaactattttgttagtcttctactgccctacagctacagagcaggcacctctgtgggcttatattgcctgtgcttgtggccttttcatttaccagtctctggatgccatagatgggaaacaggccagaagaactaacagtagctctcctctgggagaactttttgatcatggctgtgactcactatcgacagtttttgtggttcttggaacttgtattgcagtacaacttgggacaaatcctgactggatgtttttttgttgttttgctgggacattcatgttctattgtgcacactggcaaacatatgtttctggaacattgcgatttggaataattgatgtgactgaagtgcaaatcttcataataatcatgcatttgctggcagtgattggaggaccacctttttggcaatctatgattcctgtgttgaatattcaaatgaaacttcttcctgcactttgtactgtggcagggaccatattttcctgtacaaattacttccgtgtaatcttcacaggtggtgttggcaaaaatgggtcaaccatagcaggaacaagtgtcctttctccttttctgcatattggatcagtgatcacgttagctgttatgatctacaagaaatcagcagttcagctttttgaaaagcatccatgtctttatatactgacatttggttttgtgtcggctaaaatcactaataagcttgtggttgctcacatgacgaaaagtgaaatgcatttgcatgacacagcattcataggtccagcacttctgtttctggaccagtattttaacagcttcattgatgaatatatagtactttggattgccttgatcttctctttctttgatttgattcgttactgtgtcagtgtttgcaatcagattgcatctcacctgcatatacatgtcttcagaattaaagcctctacagctcactctaatcatcactaaggatgtgtctgggttctactaagctcatggttcctgcaagaaggaattcgaacatattaaggacaacaggggtggataagaacaaatataatttataataatcaatgtcatataactttcattctttgttactggtaacactccctaactgtcctgtttagaatgggaatttcaggccccatcctataaactgaatatgttgtcaaacagggtttggctccagaaagcatgcagggaaactaccgagtgtttgtgattattcagaatatcactatcataggagcacatccccactggtggtaaatctaatgtaaaatttttgcaggccaaaagattgttgctttatgattttaacaaatcatcatcttttcgtaacaccttgtttattgtcttctcagatgttcttttgtaaggagctcagcttgtggcacatacatcttactagcttgtgaggtgagagcagtgataaggaccttaaatttagatggaaggtttcctgtctgtatattgttgaggaagtgattttattatcaatcaagaaatggtgtttctcacgggcttgggaaatcttgatagcatgcagataatgtggtaactttgtcaatccattttatttttttaaataaatatatgatctcagaaccagcttttttctcaattttattcaggggaactgtaaactaagtttcaatgttttttaaaagttaaacaaattttatttctcttctttaacaattaaggaaatatggtcagccgtgtcatcatggtgtgttcatttttttcaacctatgggtctttattttgcagttattaccccattatttcagtaattgttcagatggggtggaggtgggttgtcactttgtactctccattttggtatttagactgcgctttaccataggagccaggtttctctgtgaatcacatttgctttcattgtatacatattttctgtttctttagtataaaggatagtgaatcccagcactcagaggtagaagcaggaagaggagcagaagttcaaggttatccttgactggagttgtaggctagtctgggctatataagacacagaaaatcggaggggtcaggatataaagataatctctgacaaggcaggagaaagaagaggtaatcctccattagtacagttatatctattgttttatttgattagttcagcagacctaacaggtgtttatacctagtggaaattgagacctcaattggctaccagttgtcacacagtattgctacatttgagaatggaatttaggctgtcattctagctattttttgtatcactccaaagctttaaactgaggtactagagactaactgaaataaatacatgtgttctagt

SEQ ID NO: 252 - DNA, 2090 bp, Human
cgaagcactaggccgtttgaggatctccgctccgctttgcctgggaccaggaaaagacgcgagagacggaactcggcatcaggcactgcttggggcaggaggagagtaggggaaaccaaggaagagaacagaaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatggggttggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 253 - DNA, 2195 bp, Rat
ctggccctccctccccaggagtgcgggcgcccgcgggaggccccgtcgtcgccgcctgggaccctggcccagctacgcgggtcgctcgggacgtgcggcggtgtggagtgaggttcctgaaggcttcaaaggaaacctgatagaggaggctcaatggccctgagtgaagatgaggctgaggcagaagtgtctgtcaacacaaaggtcccatcctgtggcaggtggaactctgggaagctgctgccctcagggcttgaaccagatcagcccctacatctgggtgttgagggggggccactgtggagggctgaagctgaccctggctgcatctcgggagttttcttgtcacgggtccatactgccagcaaagaaccagtagcagataggtctaagcctcccctcagaggcccgcttccttctgccagtgtgggcactggagaggttttacactctatgggcagccaaatggaggaagacaggcttcctgcctcccaggacctacttccagctcttcaagtctttggaactataactgtttgctcaggacaggaggctgacagtgaagacttccaggctacgcttgatccatctcaggtgttgggcctcagccagcaaccacacacctcaggtctccctctcccgccacagtggaagtccacggtgagcccaggtgctcctcagctttctagcagaagcatctctgcctcctcggtgggcagcagtcttcaggatcaccaagagaaggcaggacctcagagggcctcttttgccaatgtctcctctcccgagttgactgtaccccaggcagcccactctgtggtgggggcagggcctccgctccaggggtcagcacagcctctgacctctggcagtgatgctacaggcctgggtaagagacacctctcctttcaggcagaatactgggcctgtgcgctgccaaattctctgcctccttcccctaaccgccactccgcactctgggacccaaataaagagtatgaagatctgcttgactacacttacccactgaggcctgggcctcagctcccaaagcaacctgaaagtcatgtcctgactgagcctgttctgcaggactcaggtgtagatctggacagtttgtctgtctccccagcaagtactctaaagtcacccactaatgtctcccacaattgctcatcagcagaagtgcctactctgccattttctggagccagagagtcatgtcttaagcgctggcccttgggaatattccagaaacagggtggcacaagcttgtcatcctggaaccagcttgcatcaacccctagagccccaggcactgaagatgcttcttgggagaacagagaggcagccctgaggggcacagcggaggactgcctccctataggtgaggacctccgaatgggctctccccagctgaagacgaaggagaaagagccaccctttcccagacagaagagaggcaggcagcatgttagctgcccggcctgtgtgacgcctggatggccatcagaagaggaggtgggaagtgatgaggagtaccttgctctgcccaccaggctgactcaggtctctagtttggtgtcctactcaggtgccaggccctcctttgtgaacctacacactggggctgctgaggaacacagttcactacaagtctcagacagtgacaagccagcctcccccacattggactccagccacaggaagcatccttctggaacttcctttcaagggcctgtgggccagaacccctgcttcaggcattctatccagccccaggactctagaggcaaaagtagtctgatgagtaaccagaccctcggggtctcttcaaaaccactgaaaactcagcccgcctcaaaagccatgacggacaggcggctgttctccgagctagtagctggagagacacttcccaggacgacagatgagcaggagaaagcttctctagtgcagtgtgtgcagacattttgctgtcggctggaagagctgatctgctggttgtataatgtcacagatgttgctgacctcagtgctccacccaggaccagccttacaggtctcaagtcttctctgcagctttacagggtaatatgtagtcctggcttgtttatccacggggatgggagttaagtcacttttacaaaataaaatctcaagtaactggaaaaaaaaaaaaaaaaaaaaaaaaa

SEQ ID NO: 254 - DNA, 2195 bp, Human
tcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacgggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaaaaaaaaaaaaaaaaaa

SEQ ID NO: 255 - DNA, 1335 bp, Rat
atgagcgaggagacggcgacttctgacaacgataatagttatgcacgagtgcgagctgtggtgatgaccagagatgactcaagtggtggatggctaccactcggagggagcggactgagcagcgtcactgtcttcagagtccctcatcaggaagagaatggctgtgcggacttttttatccgtggagagagactcagagacaaaatggtggttttggaatgtatgcttaagaaagacctcatctataataaggtcactcccacatttcaccactggaagatcgatgacaagaagtttggccttacctttcagagtcctgctgatgccagggcttttgatcgaggcattcgaagagctatagaggatatatctctagggtgcccagcgtcaaaaactgaggctgaaggaggagatgatgatttacaaacgactgaagaagacacttcccgttccctagtgaaagatcactttttccagcaagagacagttgttaccagtgaaccttacagaagctcagacataagaccgttaccctttgaagatctgaatgccagaagagtctacttgcaaagccaagtcagccagataccattcagtcagcaaggcctagacattcagagccgaagtatggaatatgtacagcggcaaatatctaaggaatgtgggagcctaaagtcccaaactagggtccctttgaagtcaatcagacatgtcagctttcaagatgaggatgagattgttagaataaatcctcgagatatcttaatacgtcgatatgcagactacagacatccggacatgtggaaaaatgacttggagagagatgatactgactccagtgttccattttctaaacaagacagtaaaaagtcagactatctctaccactgtggggatgagactaagttaagttctctgaaagactctgtggtatttaagacacagcctccctcgttaaaatttaagtcaaaacgaagaaaagaggatggggaacgttctcgctgcgtatactgccaggaaaggtttaatcatgaagaaaacgccagggggaaatgccaggacgctccagatcctgttaaaagatgcatatatcaagttagctgcatgctctgtgctgagagcatgctatatcattgtatgtcagactcagagggagacttttctgatccttgttcgtgtgacactagcgatgacaagttctgcctaaggtggttagccctggtagctctgtctttcattgtaccatgtatgtgctgctacgtccctttgagaatgtgccatcgctgtggtgaggcatgcgggtgctgtggtgggaaacataaggctgctgggtga

SEQ ID NO: 256 - DNA, 3816 bp, Human
gcggctcccctctctcgggcgtgaggagctggcccgctgagctgctgttgctcccccgcctgctgttgctcctccatctccagatcggatcacggtgagggaaagatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaaaaagtttggtcttacgtttcaaagtcctgctgatgctagggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgtcaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatagatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatataacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttatactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaacagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcctcattaaaaact

SEQ ID NO: 257 - DNA, 3258 bp, Rat
accactgcttcattgctgctgagaatgttccaggctgagtgagaagtaaaaattcatcatctctgaagaactcttacccagccctgttgaagaaattcccagaatgttgatgggagcaactagagatatgggaagcaggtgccttctgcatgcctcagttcctggaatgctgcttatctggtcaatattacaaatgatgaatatttcagcttcctgtccccagtgcaatgaaaatgccagctgcttcaacagcacccactgtgtttgtaaagaaggattctggacgggctctgagaatagaagaattattgagccccatgagaaatgtcaagatattaatgagtgtctactgaaagaattggtatgcaaggatgtgtcgtactgcagaaataaaattgggacttacatatgcagctgtgtagtaaaatatcctttgttcaactgggtagctggcattattaatattgatcaccctgattgttatgtgaacaagagcaagaatacaggatcaaaaacacatactttgggagtactgagtgaatttaaatccaaagaggaggttgcaaaaggagctaccaagttacttcgcaaagtggaacatcacatcttgaatgaaaactcagatataccaaaaaaggatgaaaatcctttattggatatagtgtatgaaactaagaggtgcaagacgatgactcttctagaagctggcaacaacacaatgaaggttgactgcactagtggtttcaaagagcacaacagtggaggtgaaactgcagtggctttcattgcatataagtctcttgggaatcttctaaatggttccttttttagtaatgaagaagggtttcaggaagtgacactgaactctcacatcgttagtggagccattcgctcagaggtcaaacctgtcctctctgaacctgtactcctgactttacaaaatattcagcccattgactcaagagcagaacatctctgtgtccattgggaaggatcagaggaaggggggagctggtctaccaaaggatgctctcacgtgtacaccaataattcctacaccatttgcaagtgtttccacctgtccagctttgctgtgctcatggctctaccccatgaggaggatggtgtgctttctgcactctctgtgatcacctatgtgggactgagtctttctctcttgtgcctatttctggcggccatcacttttctcctgtgccgacccattcagaataccagcacgacactccacctgcagctctccatctgccttttcctggctgacctcctcttcctcacaggcatcaacagaactaagcctaaggtgctgtgctccatcatagcggggatgttgcactacctctacttggcttccttcatgtggatgtttctggaagggctacatctttttctcactgtgagcaatctcaaagtggccaactacagcaactcaggcagattcaagaagaggttcatgtatcctgtaggatatgggcttcctgcttttattgttgctgtatctgcaatagctggccacaagaattatggaacacacaaccactgctggctcagccttcatcgaggattcatctggagcttcttggggccagcggcagccattatcttgataaacctggtgttctactttctaataatatggattttgagaagcaaactttcttctctcaataaagaagtttctacacttcaagacacaaaggttatgacatttaaagccattgtccagttatttgtgttgggatgttcttggggcattggcttgtttattttcattgaagttgggaagacagtgagactgatcgttgcctatctgttcaccatcatcaatgtcctgcagggtgttttgatatttatggtacattgtctgcttaatcgccaggtgcggatggaatataagaagtggtttcatagactgcggaaggaagttgaaagtgaaagcactgaagtgtctcattctactactcacacaaaaatgggtctttctctgaacctggaaaatttctgcccaacaggaaacctccatgatccttctgactccatccttccaagtactgaagtagcaggtgtatatctaagcacacccaggtctcacatgggtgctgaggatgtgaactcaggtactcacgcttactggagcagaactattagtgattgaatcagctccttcccccaagcctcttacagtacattttaacttgtactgtgccatgcacatgaagctataattgctagtctggtaaaacaactgttgcatattccatgatcatttcattttatctctacttgcaaaagttagctttctttttatatcatttttatttctctttcttttgtttatatatagcttcagttgagtgggtttctagtcttaatgttctagatcactattttcttttcagttaacctttattggtatttagttcctgtgtagtgtataccactggaatatttttatttctttaattttgaggttaaaatatagttacatcatttttcctttttttctttcccacaatcctcctgtatactttttccctggtgtctattttattgtttctacatgcatatatattttatgcaaaacatatatatgtataaatataaatatatattcttatatgcatgaaaaccatctacttcatccaaataatgttccttctatgtatgttttcaggacagggacaacaatagctatggtagcatggcaggggaaagcccacaggacctcagccttatacaaagaatcagaggcaactgaggagtgctgagttgaaggaattgtcttacccaggggagggcacattaattggttatctaatacaaaatgttcagccccaaaactgttaagataaaagcctatatgcatcttaggaagtatctaccttgatacacctttattggaatatcatccacatgtttattgtgtgttctgaagagggtctgttgaatttctaagggttgatcagtttaattgtgccattttatattcagggtgtttggctttgttgtagtgaataatgctatatttccctgtatgtgtcatctttgactgttattttttcctggcgatactttattcaacaagaacctagagccttggtttattactttttcttccatagaaaaactatttgtcttccaggattagatatgatcaatatttcttatatgcatgtatcaaatatcatgatgaaatatattactgtgtataattaataactggcaataaagtccaaggga

SEQ ID NO: 258 - DNA, 1371 bp, Rat
atggggagcaggttcctcctggtcctgctctcaggtgcttcctgtcctccatgccctaaatatgccagctgccacaacagcacccactgtacttgtgaagatggctttcgggccaggtctggcaggacatactttcatgattcctctgagaagtgtgaagatattaatgaatgtgaaaccgggctggcaaagtgcaagtataaagcatattgtaggaataaagttggaggttacatctgtagctgtttggtaaaatatactttattcaactttctggctggtattatagattatgatcatccggattgttacgagaacaatagtcaagggacgacacagtcaaacgtggatatttgggtgagtggggtgaagcctggatttgggaaacagctgcctggtgacaagagaacaaaacatatctgtgtctactgggagggatcagagggaggctggtccacggagggctgctctcatgtgcacagcaacggttcttacaccaaatgcaagtgcttccatctgtccagctttgccgtcctcgtggctcttgcccccaaggaggaccctgtgctgaccgtgatcacccaggtggggctgaccatctctctgctgtgcctcttcctggccatcctcaccttcctcctgtgccggcccatccagaacaccagcacctccctccatctagagctctccctctgcctcttcctggcccacctcctgttcctgacgggcatcaacagaactgagcctgaggtgctgtgctccatcattgcagggctgctgcacttcctctacctggcttgcttcacctggatgctcctggaagggctgcacctcttcctcaccgtcaggaacctcaaggtggccaactacaccagcacgggcagattcaagaagaggttcatgtaccctgtaggctacgggatcccagctgtgattattgctgtgtcagcaatagttggaccccagaattatggaacatttacttgttggctcaagcttgataaaggattcatctggagcttcatggggccagtagcagtcattatcttgataaacctggtgttctacttccaagttctgtggattttgagaagcaaactttcctccctcaataaagaagtttccaccattcaggacaccagagtcatgacatttaaagccatttctcagctatttatcctgggctgttcttggggccttggtttttttatggttgaagaagtagggaagacgattggatcaatcattgcatactcattcaccatcatcaacacccttcagggagtgttgctctttgtggtacactgtctccttaatcgccaggtaaggctaattattttgtctgtcatcagcctagtcccaaagtctaat

SEQ ID NO: 259 - DNA, 3108 bp, Rat
gaaggagaactgccatggctgcagctgcacgcgctcgagtcacacacttgctgaggcacctacaaagcacagcatgccagtgcccaactcattctcatacttactcccaagcccctggaccttcgggaaaaacagcagattacgcctttgagatggctgtctcaaatattagatatggagcaggggttacgaaggaagtaggcatggatctacagaatatgggagctaagaatgtttgcttgatgacagacaagaacctctcccagctccctcctgtacaaatagttatggattccctatcgaagaatggcatcagttttcaggtttatgatgatgtaagggtggaacctacagatggaagcttcatggatgcaattgaatttgccaaaaagggagcgtttgatgcctatgttgctgtgggtgggggctccaccatggacacctgtaaagccgccaatctgtatgcatccagccctcactctgagttccttgattatgtcaatgcccccattgggaaggggaagccagtaactgtgcctcttaaacctctgattgcagttccaactacctcagggactggcagtgagactaccggggttgccatttttgactatgagcatttgaaagtaaaaactggcattgcttcacgagccatcaaacccaccctgggactggttgatcccctgcacactctccacatgccttgccaggtggttgccaacagtggcttcgatgtcctttgccatgctctggagtcatacaccgccattccctacagcatgcggagcccctgcccttccaaccccatccaacgaccagcataccagggtagcaacccaatcagcgacatctgggcagtccatgcactgcagattgttgccaaatatctgaagagggctgtcagaaacccagatgatctggaagcaaggtctaaaatgcacttggcaagtgcttttgctggcattggcttcggaaatgctggtgttcatctgtgccatggcatgtcttacccaatttcaggtttagtgaagacatataaagccaaggaatataatgtggatcaccctcttgtgccccatggcctttctgtggtgctcacctctcctgcagtgttcaccttcacagcccagatgtttccagagcggcacctggagacggcaggaatattaggagccaacatccgcactgccaggatccaagatgctgggcttgtgttggcagatgccctccgaaaattcctatttgacctaaatgttgatgacggtctggctgctcttggttattccaaggatgacattccttcattggtgaaaggaacactgccccaggaaagggtcacgaagctcgcacctcgtgcccagtcagaagaggatttgtctgctttgtttgaagcatccatgaaactgtactaattaacatattagtgaaaagaatccccattggcctttgcgacagaagttacaaatagcagaagttggccagagctgatgttgccgtcttatctccacacttaactcacctattgctggtttgaatgtgatgtgattttatcctttggaagattccttggtgctcattacatggaacccatgggccataccccaggggtcagtattcctgtaccaaaccccatcaaatacataaaaatgcctatctccaaacactgcatgtctagacatttaccctgaagaaatactagcattagtgtgcaaaaaaaaaacaatgcatactaggttgcacacaaggatgagtctgacatatttttagatagtaaaaattaaaacaatctaaatattcaatactgaatgaatcctaatatagtaaatgatagaatactgtggtattattaataaaaatgaagtaaaactcttgaaaatatgtctgtttcataaaagctggtgtcaggaaacaagtggcagaaaggctataaagaagagtctgacttaacttttcaactgtatatgagtgtgtctatatagagaaaaaggtgcacattaaaatattaaaagatatcagagaagagaattcaggagtataataaattaaagaaaaaaatgtgtactgagtattttatgcttccaggctttttttaaggtgctgaaattagaacccaggatcttgcacacattaggcaagtaatctaccactgagccacattctcagctcttgggttttaaggtagagtcactctgcatgtcttcggtttaaggctggttttgaatttggggttcttctgcctctgtcttcccagcgctgagattatgcaccatgcctcacctggtctcccattttgtattttatacatacttattgtctgggcttgttaaagaaaacaatttcctaatcttaatgggaaaggcagggttgggatgatgacttagtaggcaaagtgcttgccatccatatgtgaagatttgagttcggatcctcccctcacatccatgtaaatgccagccacagctttgtacatctgtaaacttggcactgtggtggtaggtagagacaagcagaaccccagggctcactggtcagccagttgagattcatcgagagattctgtctcagaatataaggtagaaagtaacaggaagacatctaatgtctacctctgatctctacatgcgcacacaaacacacatgaacacatcatactacacacacacaatcacctgtgagccatatcaccatttaccctacgaacagcacttcacaagactcaaggcaagcaatggcagctagtgcaggattgctgtgcagggcaggaggctccagcaggatgtggctacacatctacttgatggacagcacactccaccttgctcggtggaaatttgtgaaaactttttcaatttggaattggttgactttcagatgtagagcctgtgagtaatgtctttcctgtactgctccacggtgttatttagagcccctggggtaccggatttctgttcctgtcacctgaacctttatttaaccaacccctcgttagcttgaaaatgttataagtatattttatatattatctactcttgaatgtgagattctttttaattcaagaaatttaatgaaaaacaatttgagatataaaaatgaattctttatccttcg

SEQ ID NO: 260 - DNA, 1831 bp, Human
gaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggtatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatattgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccctgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatgagcaaaaactcagtatctatcaaaagtgtaaattatatttcctatgcctagtaattcacttcatgtctaaaaatttatctgatagaaacactagcaccagtacatacagaagcatgg

SEQ ID NO: 261 - DNA, 2990 bp, Rat
gagtgtgagcaagaactcgggctggcaatcacagtcccaggggtgtcccactcctgggctgaggtggacacagggtgctgcccacggggtcggtagggcgcaggcgccggtctggcagagcgcaagggcagaatggaggggctggtcttgctcaaggccctggtcacccggctgctgttcctgttgcattccctggtcgccgtctggagagtgacctgggtgaaggaagagcaccgttactggctgctggccctgctcaacctcttgctggtcctggatacagtgctcaccctcaagttcaagcgcggacgaggctacaaatggctttctccggccatctttgtgtacctggtcaacatcatgccgtccctgtggcttcttgaaatgcaccatggaaaccagtattgcagcacccaatctgagagaatggcacagaacttcagcagaagaggagatgtcaatcaaaccctgtcatcccacagagccaccaatggaatggggaatatccttgagctggccagaggctttgtcgacaatttatccatggtatgtgaaccggtctggaccttaggactccaccaaacactcctgctaatattaatcattggacggtggcttctccccattggaggcaccatcactagagaccaactctcagaacttcttctgatgtttgtggggacggcggccgacatactggagttcactactgagactctgaaggaaaataatgtcagaaccaaccctactctggtctctggcattcttgtggtgtggacgtggagtatgctgcagttcccccttgatctggcagtccagttgaaactggtatgccccgcctcagtgaaagccaggggcttccttagggttttcctgtgccagtacagtgcggatctatgggccattggtctcagcttcttcatccaagacggtcccttcctggttgtgcgcctcgtcctgatgatctactttaaagtgatcaaccacatgttggtgttctttgccgtgaagaattccctagtgatggctctgcacttctaccgacttgtggctttgattatggccacgagggacttcatgcgagatcatccagaaagccccaaaccggagcacagtggcccagaccagccctctgagagtggtcccagtgaatgggaggatgcttccccggaggctctgcctttgcgaacctcacctgtcacctccgaggagtcttacccgacgacaccttagttattgcttccaacatgaagctgcgaggcttaactcgttccttcttacgcccccatgtttgcatacaccagttttttaaggaaacaatacaaaaagatgatcttgtatcaaagccaagataattttttttttcatctgagtggaaggaactttgacgtcgaatggctgtctctacaacctcctgctctggtagcggacattacaccgctccgagaaccattctaaatgattggtttttatggaactgcttgaaaagctgtagacagaacggcatagcacacccttcaaagatttaaggcagacatttaccacccccttccctattccttgctctccttgggtgcgtagtactacagcttttgactggctggactacgtcactctctcatctgaggttttttgcaatgtccctctgacattaaaacaaaaaatgtatattcagtgaacgctgaacaaaagagaggaaaatgattttaaaatcaatttgctggaagttgggagctagtactgccctgcttcctcggtgcagaaaaatagctgaggtagctgcacaggcctttacaggaatgcccttttcctagaccaaggtgacattccatgtgttcttagagcatcgtgatggctttggacttgggtagcacaaagtttacagcaagccacttgggttctagcaacttcatagtgagtgagacagctgcaaggcacactttctacctaatgcaatttacgggaccgttgacatctgaatacctgattacctttttctaagttgtcaaggtgcatcatgggatcaatttcaaagagcactagcatgcagtgatgaaggaatttgaggccctttagtgttaccatggtttctggtaggggccagcagcctctgcaggagcagcaacactaacagagttcggcctgaagcctgggaaataccaccagcggccccagcctggtttcaggaacaagttggtggcagttggtgccagtctcatgcctcctgggaatcatggtggcttcatttcccatgaacgaaatagtcggtctcttccacagctctgtacattctgggtggaaataactccaaacttttgaaagtagctcttgcttttaaatataattgtgacttggcaattttcggaagcgctctaaaactgtagtgttagagttcaaagcatcagccaagctatgctagaatccccaggaacccaaagatgtttattcaggaaacttcctaaattggaggcaaccattagacaatcagttgggacaattttttttttaaatctatgaatttctggtatggtatttatccactatgtttgataacaagtatataaacacattctattttatacaaagccacaactgtttttctagtaatttctccttcttttatcccttgggctttttgtttttaacagtgtcatggttgtaaacggttcacgaaatgaatggaatgcattggtaatttttcataataagtgtatgcaagttaaggtcaaattttaaaggtgtgttattcaaagttcttatcaatgagatttgggagcttggttaaaagcatgtattgctcttgcagaggatcaggatttatcccaaaatctactcagtaggtcttatatccacttgtaactccagcttttgaggggtctacttctagcctctgtgagaactgactgcattcgtgtgtacacatacacacacatgcagatttattaaaaataatgaaaatattttacaataaaaacgtcagcaatgggaag

SEQ ID NO: 262 - DNA, 2581 bp, Human
ttcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggctctgttggaaaaattccactaatagaagacatactaaccccaagtggcaacttgttctattttgagggtactggttttctatccacgttctatgccatatgtgcatgtgagaagccttccatcaatgtccaccaagtcatgataaaatgtgaagtagaaaagaatcaaaagcacagccttcaacaacccattggagagtccccctgtggggagccatttacacaggaatccacctaacagtattcacacctggaatatttcttaattttgttaatgaggacactatgggagactttttcagaagccttgtttaaatctgaatgtctgtcatcaatttacataacattacctgcttggtaatcctaactatattttttaagaggaggaactaagtttaattgagtgcaatttttctcagaggacctgtgctgatgcttcgtaataactgtgttcttctaaaagggctctcagaaatcttttaaaggatcatttatataatctaactagagattaatagtaaatgtgccttttgtacttcaagacatatttctgcttcattttgaaagttgagactttatttttttatcaccaaccttgtctccaccattaactgccaagacagataatgatggtttagaaatctcatttacaaattctctcagagttttgagatttaattttgtatttaatgcctctacacttgaagcatttaaagatatcccttacaatcacctcatttcttttggtttcaattactcctccttgatgcttttcagacctcttcaatctgaaaatctcttttgatggaagatggaaacaaaatctattattatgctaccaagctcaaattgatgacttcctttctatctttgctaaaaataaatgtgaccctgtttaatatcctttgcatttctgcaacctctgttctttctgattttagccttcatgaccattttcctaggtctaggacatttgtatatttgtctgagtatggacccttctttggtgcttttaaccattccttccataaatatatgttgtatccatcaagcactgttctaggcactaaggatacagtggtgaatgaaataggcttattccttgctttatgtcctactatctggtataaatctttgtttattggatttatctccttacctttttcctatctaatgacaattttatttcaatgttgagtttttaatctttgatcatcatttagctcttttgaaatgtcttttcaattcgatccctggtttcttagaataattattaatcctcccactgacattccttgaaatcagccatttgaatatccatgttaatatctatattttctcccctatcatttttctcccataatgtttccataattttgtaaaactaaagacagcaatatgggaccaagaggctttgtcataattcatgcatatgttgggctttaagtctcagattatttatttttcacttcttcattattccattattatcatgtaaggatttttttcattgatttattaaatcaccaagatattttggccacaagaggtttattaggaatatactaaaaaacttgactgagaagacttttctgcatgtgatcatactttttattacaaatttaacattttgtctgtattctaggaatagtcctgcactagtctatgccatccttgttatatggacttggagcatgctgcagtttccacttgacctggcagacccatgtattagaacttcagaagacataggagcagttaaaattgtcctcattggaggtcctcggaatcctactggtcttactttaataaaaacataaacccctaaaaaaaaaaaaaaaaaaaaaaaaaaaaaaaaaaaaaaaaaaaaaaaaaaaaaaaaaaaaaaa

SEQ ID NO: 263 - DNA, 184 bp, Rat; identical to SEQ ID NO: 49

SEQ ID NO: 264 - DNA, 268 bp, Rat
cggccgcacaagggacgtaacggattcggctgcttggatataagattccccttggtcagccagtgaggattgattcagggggcctgagctcaggacttgcacagctgagtgtgaaggtggcacaggagctgcctgcaggtcgacattttgctggagagctggtggggatgtgccaatcagggcagggcagcacggaggaacccactcctgggctgcagacctgagggcaggaggtgcagacctgcctgccccttcctcaagaccccat

SEQ ID NO: 265 - DNA, 1790 bp, Rat
ccaaggaacagcactatttgtaactccaaagaaatgagggcaccacagatgggctctctgggatttctagacaaaggccacattcccctggtgttgcagctgctgttcctcattctcttcactggacttctggtggccatcatcatccaagtttccaagatgcccagctcagaagaaattcagtgggaacacacaaagcaagagaaaatgtacaaggacctgagccaactgaaatctgaagttgatagactctgtcgcctctgcccttgggattggacgttcttcaatggaaactgttactttttctccaagtcacaacgggattggcatgactccatgactgcctgcaaagaaatgggagcccaactagtcatcatcaaaagtcatgaggagcagagcttcctgcagcagacttccaagaaaaatagctacacctggatggggctgtcagatctgaacaaggaaggagaatggtactggctggatggttcgcctctgtcagacagctttgaaaagtattggaagaaaggacagcccaacaatgttgggggacaagactgtgtggaattcagagataacggctggaatgatgccaaatgtgaacaaaggaaattctggatctgcaaaaaaattgcaactacctgtttgagcaagtggtgaccagacgttctctgcagtttgcacagcctaaacatcccagttggggagtggactttcactcatgcgtttcccagttcctactccctgtctatgggcatggaaatcttagtattacctctgggactcatcagtctcctttgttagtcactatagtgctagaccactgaggtccttcctttgatgtctccaaactcctaacgcataattgtggttttgccattgaatttaactacattgaagttgtgtatccactgatgggctgggtgtgttccattcatctcccctgtctttcttgttgaggtcagagggtttacattactataattactataatattcattacattgatacattgtcccatgctgtttgagctcacagagaagctggctctggaattatggttgcctgtaacatcaaagcatgtttacctcaaagtgtcattcaaagaccttgtctagggttaggtagctcctgcccaactgtgtaacagggaagaaagagattagcaagacagcttaagagtaaacacattgcgcccttgggaacagctagaaggtgaacattaccaacaggtgttactaatgtttatcccatatgaaagtgcctgcagtggaacagagaacccagaaattcacccatgaaaagctcggcaatggagagacagctcaataccaaactccagttgcttgcctcaacttcctcaatcagtttctgctgacttttgtgggaacccagatttgaggatgtcatttctatcttctgctatctgtacttttgcctaaagggttatcactttgctcttctaactgccttaatggaacttccttggtcattttctgctgggtgtttgtaagcttctgactcagtcatgctatctttccactgctatttgtacttttacttggaagcctcatcaagggacactgctcttcccagatgtccttgtgttgggaactccagttggctgccttaaaggggcttctctctttaatttatgcctgacactttgaacactcaacttggtcatatttggtgtctatttatctacccatcacttgctatttatccttttactttggtttgctatgtacttaataaactcattcaaatcaaaaaaaaaaaaaaaaaaa

SEQ ID NO: 266 - DNA, 4266 bp, Rat
tggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctcatacatgcaaacctaccatctgttcaacttccacctaccacctcctgcacccctttgatcggggacttactggttgcaagagctcattttgcaggctggaagcaccagggaattaattcccccagtctaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccaggcccggctaattttttgtatttttagtacagacggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttactgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgcttggtgaattgtgcctctcctggctctttgacatgtgctagtgagatttcttccttttcctttcggattccccatttcttttgtaggaatggtctggactagggttctccttccccgcagcctgtagtattcatcgtggtggcccatcctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactctactaaaagtacaaaaattagctggcgtgcaccaccgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaaatggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctaca

SEQ ID NO: 267 - DNA, 243 bp, Rat
ttcaacctcatctctcttctatgatgctttttgttatgtaggcactcccatcctgaatttaccttgtaaagatgcaatcaatttcaaaggaagacaaacccactgctgtctgtacactgtaaatatgtattttggcacttgtactccagtattctgaaagcagagctatgatggaaatgctgacagatttttgatggtggccaaagctaccctacaaaaataaattaagtaaaaatgtatttt

SEQ ID NO: 268 - DNA, 414 bp, Rat
ggtacaaacttgctttcctaaaattgagcctgtgggttggtttattaaagaaaaagcaaatgatttcctataaaaatatatgcatatcatatatatctatttatagataaaattattctggctgcctaagcatcaaattcataaaaatctctttctacaagtttttttcaagtatctttatgacaaagaaaatatttagggtctacattgcccatgatcctagtgcctgggagcctagcctgtccttctggtatttgggttcatttccttgtcttccccaattttcttccacagtgtatagatcattattttgccatcataagaaaagagacctgattgttgctcagtcagagtaattttgcctggctagggcatgttccagtcctacaagtgtagaagggcacttgtgagctg

SEQ ID NO: 269 - DNA, 414 bp, Rat
  misc_feature (66)..(66): n=a,c,t or g
  misc_feature (168)..(182): n=a,c,t or g
  misc_feature (208)..(229): n=a,c,t or g
  misc_feature (247)..(247): n=a,c,t or g
  misc_feature (276)..(276): n=a,c,t or g
gctgagaccggagctcctcaccagtcccttctctctgggactcaaagctgggacactccccgaagntcttcaaccctgtttggcaggggtaaccagagatggaagacccggctaaaattgctgtatttaccacccactttccctggggactggacttgggacaagtannnnnnnnnnnnnnntaagcaaggtagggtggacacaactnnnnnnnnnnnnnnnnnnnnnnctatcctgagctgtcaanctactaaacagggtgtgagggctgcggcntgcccctgcctagtgagaaaaaaagggaagagtaagacaattgtccagcactagcagtctcaggccccaaggcagaggggcccagaggcggtgaagcgactcttaccccgcccccaccctgctgctgagtctgtctga

SEQ ID NO: 270 - DNA, 1095 bp, Rat
agcgcggacgcggacgagtgggaggcctattgcgccagcgaattcgcagcggtgaatggaatcgtgcacgacgtggacgtgttgggcgcgggcatgcgcctggtgactcttctggtggaccccgacgggctgtacaagatgagccgcctgtacatcactcccgacggctttttcttccgcgtgcatatactagccctggactcctccagttgccataagccgtgtccagaatttaaacccggaagcaggtatattgtgatgggccacatctaccataagagacggcagctccccagtgcgctgctccaggtcctaagggggcgcctgcgtccaggagacgggctgatccggggtagcagcagctacgtgaagaggtttaaccgaaagcgggagtggcaagttcgaggtgccacccacacccagtgcatttgaacttggcacttggggtcggtcttcacgtgacgggaagcttctgtgaaaccgggctaccttatggactccgtgtgcggcttagctgtcactttatctacaaaatgctgacaggtgtgcttcaggacactgtgcgaaagtccctcgagggcagtcatgcacacaacccagacaccagaccccgtgggccaacagatcacaccatttttgctgtttttaagttattttaatttaatacattccccccagtggagacagttcacaaaacagttctcgaatttaaatatacaactttgactagtatctatcacgtggtgtcaagccagattttgtatttaaagcatggagttttaaattccacatgcgggagtaaacaccctggtcatttacatatgaaatgtcatatagatcaaacagcagccaagtgcaaaaactattacatttcaagggctaattcaagcaaaacaccattcaaggtgtgttcctgctgtaccacacaatacaagcccctgtgtattgccatgcctccttgctcccagcaacctgttttgtgccaaactggcatcgattccaggacgttttctggtgtatctgatgccattttgatgttaagacctggtaatatcatgattgtgtttgcaaaacagtaaatctcgctgtgaaatc

SEQ ID NO: 271 - DNA, 1357 bp, Rat
gccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcaattcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtattaaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatc

SEQ ID NO: 272 - DNA, 1516 bp, Rat
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgctagaactctccatccagcttggtgattgaacatctgtctcccttactgcgggtggccagccacagtgccccggagggatctgcacaatgctccagcacactagcctggtgtttttcctcgcctctatttggaccactaggcacccagtccaaggtgccgacctcgtgcaagacctttccatttctacatgcagaatcatgggcgttgcccttgtgggcagaaacaaaaacccacagatgaatttcacagaagccaacgaggcctgtaagatgctgggactgactctggccagcagggaccaggtagagtcagcgcagaaatctggctttgagacttgcagctatggatgggttggagaacagttctctgtcatccctcggattttctcaaaccccaggtgtgggaagaatggcaaaggtgtcctgatttggaatgctccctccagccaaaagttcaaagcctattgccacaactcatccgacacctgggttaactcctgcattccagaaatcgttaccacattttaccccgtgttggacactcaaacacccgcaacagagttttctgtcagcagcagcgcctacttggcttcatcccctgactccacaacacctgtttctgccaccacccgggctccacctttgacctccatggcacggaagacaaaaaagatttgtatcacggaagtttatacagaacctatcaccatggctacagaaacagaagcatttgttgcaagtggagcagcattcaagaacgaagcagctgggtttggaggtgtccccaccgccctgctggtgctggctctcctcttctttggtgctgccgctgtgctggctgtttgctacgtgaaaaggtatgtgaaggccttccctttcacaaccaagaatcaacagaaggaaatgatcgaaaccaaggttgtaaaggaagagaaggctgatgacgtcaacgctaatgaagaatcaaagaaaaccattaaaaacccagaggaggccaagagtccacccaaaactacggtgcgatgcttagaagctgaagtttagatgcaagagagtggagaaagtgcacacgaggcaagtttcatgccccgggaaccaaagaagcaagccactgtcagttcctgcagaaaaagactgcagagttcaccagaaggagccctctccttactgcagtcttctctggactctaccctctggcctccaaccttcccacagcctccctaacccttctgtggctcacagcagaccagagagtagagggagctttcaaagtaccaggtcctaaaacagctcctaagctcacactcagagacaggcttccaggttgcctgacccccatgaaaggccagagtccctgagacat

SEQ ID NO: 273 - DNA, 2313 bp, Human
acgagcatccggactagttattgagcatctgcctctcatatcaccagtggccatctgaggtgtttccctggctctgaaggggtaggtgtgatggccaggtgcttcagcctggtgttgcttctcacttccatctggactacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgacacagccttgaaagctagctttgaaacttgcagctatggctgggttggagatggattcgtggtcatctctaggattagcccaaaccccaagtgtgggaaaaatggggtgggtgtcctgatttggaaggttccagtgagccgacagtttggagcctattgttacaactcatctgatacttggactaactcgcgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtccaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttagaaaaaaaaaaaaaaaaa

SEQ ID NO: 274 - DNA, 2471 bp, Rat
aaaatctggaacttcccgggttactacagggtctatgtcacagtgcctgtgagagaggacagagcactctgcagccagcctcagaggcaaagctgaccagcattgaaaagctgcttcttcttcttctctaaaggatttctcttcagagacaaaaagaaaccaccctggacatggcctcagagatccacatgtcggaacccatgtgcctcattgagaacactgaggctcaactagtgatcaaccaggaggctctgaggatcctgtctgccattacacagcctgtggtggtggtggcaatcgtgggcctctaccgcacaggcaaatcctacctgatgaacaagctagctgggaagaggacaggcttttccctgggctccactgtgcagtctcacaccaagggcatctggatgtggtgtgtgcctcaccccaagaaggcagggcaaaccctggttctgcttgacactgagggccttgaagatgttgagaagggtgacaaccagaatgactgctggatctttgctttggcagtcctcctcagcagcaccttcatctacaacagcataggaaccatcaaccagcaggccatggaccagctgcactatgtgacggagctaactgatcttatcaagtcaaagtcatcacctgaccagagtggggtagacgattccgctaactttgtgggcttctttccaacctttgtgtggactctgagagatttctccctcgagctggaggttaacggaaaacccgtcacttctgatgagtacctggaacattccctgaccctgaaaaaaggagctgataagaaaactaaaagctttaatgagccgcgactgtgcatcaggaaattctttccaaagaggaagtgcttcatctttgacaggcctgctcagaggaagcaacttagcaaactggagactctgcgggaggaggagctgtgtggtgaatttgtagaacaagttgcagaattcacctcatacatcttgagctactcttctgtcaagactctgtgtggtggcatcatagtcaatgggccacgtctaaagagcctggtgcagacctatgttggtgccatcagcaatgggtctctcccctgcatggagagtgctgtgctgactttggcccagatagagaactcagcagcagtgcaaaaggccatcacccactatgaagaacagatgaatcagaagattcagatgcccacagaaaccctccaggagctcctggatctgcacaggccaattgagagtgaggccattgaggtcttcctgaagaattctttcaaggatgtagaccaaaagttccagacagaattagggaacctgctggtagccaagcgagatgcctttatcaagaagaacatggatgtctcatcagctcgttgctcagacttgctggaggatatttttggacccctggaagaagaagtaaaattagggacattttctaaaccaggaggttactacctcttccttcaaatgagacaagagctagagaaaaagtataaccaggctcctgggaaggggctccaggcagaagcgatgctgaaaaactactttgattccaaggcagatgttgttgaaacacttctacagacggatcagtcactcacagaggcagcaaaggaggtagaagaggaacgtacgaaggctgaagctgctgaagctgcaaacagagagttagaaaagaagcagaaggagttcgagctgatgatgcagcagaaggaaaagagttaccaggagcatgtgaagaagctgactgagaagatgaaagacgaacagaaacagttattagcagaacaggaaaacatcatagctgctaaacttcgggaacaggaaaaatttcttaaggaaggattcgagaatgagagcaaaaaacttattcgagagattgataccctgaagcaaaacaaatcgtctgggaagtgcactatactctgaaggcccaaggcccaaacctctctgccaagctctctccatcacacactatgttgactgagcatcttcaggctttgaaacaactgctatgaaactcaattcacctcagctcaaaatcaatcatatgcgactccattttggggtcactgtctgaccactgggcactgtcagaggaagtccctctgtgtgcagaatgcatgtatgagcagaggttcagtcacctgtgttataggtactctcggccttcatcatgcccagccatacgtttctcctgtataatcttaagtgttcctctttcctacagatagcttctgtaatcacagaacaggcaacttttaactaacttgcaaaatgaattccctttcatttctctgaggactttttctactgttattccaaacctaaatctcatcccaggtttcccttttatctccccactgtgacaacatgtcttgaaattactcaagacaaatgtcttgcaagagcacaagttaataaaaatgattagcccactgtaaaaaaaaaaaaaaaaaa

SEQ ID NO: 275 - DNA, 3704 bp, Rat
acggctgcgagaagacgacagaagggggttgaagaagtacgagaagaccaactggatagtaatttccagatgcaatcagaaaatttctgttcttatatcttcacccatgcaaagaccaagaccctgagagagggaatccttgtcactggaaaccggctggggatgctggtggagacctacctggatgccatcaacagtggagcgactccttgtctggagaatgcaatggcagttctggcccagtgtgagaactcagcagccgtgcagagggcagccaaccactacagccagcagatggcccagcaagtgagattccccacagacacactccaggagctgctggacgtgcatgcagtttgtgagagggaagccattgcagtcttcatggagtactccttcaaagataaaagccaggaatttcagaagaagcttgtggacaccatggagaaaaagaaggaagactttgtgctgcagaatgaagaggcatctgccaaatattgtcaggctgagcttaagcggctttcagagctcttgacagaaagtatttcaagaggaactttctttgttccgggggggcacaatatctacttagaagcaaaaaagaagattgaacaggactatacactagtgcccagaaaaggagttaaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaacgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcggcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttgcacaccgatgctccagaattgtgagggagccatactctacagctattccaccgaggataatactaccattgtaaaggcatctcacgggaaaacaacacagctaccatgaaccagcaccatgatctctggatgaaatgctggaagcttctgcagtgtcagctatgagtaaatggatgccaccaccttcacattttcagtaaacaaatactcccctaccccatgaaaagttgcatctttgagctgctcacatctccagctaagcctcacaaaagtcaatctgcagggaagaatctaaatcatatgcctacccatgggaaagtctgagaattagagtatttttgtcttctacttttggaggaagaaactaataacgtgggaaattttcctgtatgtttagtcaaccagtttttccatgcagatgtatggagataaatcttatagtaggaataacctaagacttgagttagtatttttgtgtacatcagatacaacactcttctcatcttttttgtcattatttttcaatgttgttttaatctttccactgttgtttcatgtcatgcactttgttaatattctttaagttattcttagtttttaacaatgatacttaagaaagacttaataggactatagaataggtactccctattccccaaccctgggaacacaatataacatattagttcatttgtatttaagatctatcttgtttacgcctcagtttagttattgctcttacctttcaaacagttaatattttgtatctagttctgtgaaagcaaaaagcaactttattctttcttacaattccccttttacttaatcggaacatttctttcctgtttgttcattagtcactctcagataaatgaatagtctctttttccaaaaaaaaaaaaaaaaa

SEQ ID NO: 276 - DNA, 3618 bp, Rat
aaaaagcaaatagaagagctttacttagtctccgtgtgaagctccaggagggcccgtctcagtccgatgaactttgcagcaatattatagttattcgtgagagaaaggaatcagaatgccacagctcaaagtgaacaagcacctgatttttgcaactgagcctttcctgacccaagaagtctctaacaatattttctctaccatcaccaagtacactttatttttattaaatgatattgtagcaagctgctaaaaaaaattatcgcaaacggtaatgtaaaaacaaatcaagacactttctgaagaactgtgtaccactaaaagtaatatattcgcaatgttcacagaattccattaaacataaagaaaaaacataactgatatattgtacttaattatttgtggagtaataaccaggtacagtgaaagtctaggcaatgtggactacctcattaaataactgattgtcaaccatcacagttagatcagacctacaacttaaagcaagctgtaggaagccacgccaaaacaaaacccgatagttcccatgtgacctgactcctctgctctaatgcgagcacctttgccggtacgaaaaccttctcactgattctaactgttactcctgaaaagtggaaatgcagctgtccttacagcaaatatcatatctatctaacaacccccataggtctttcagtaatctgctcatttatcgagctcaccgaagtattcagaatctatgcacagaagaataggtgggggttgcgtttatttgcctacttcttagcatagggaagcttaaaagatgtttgttgactgcggcaaatggactcttggcaaacatttaggggaagctactcagtggtgtctcagggcccaacagctcacgcacccatgtttctgctacagtccttgccttttccattctcagtatgtctgtccgggtctgggagacgcaatatggcggaaattgtgaacaacctcgatttcttttcaaatgatatcacagcaaatgtgagaggaatagctgataattccaaataaaagaacgtcttcaaaatttccctagaaaacgatggaagtccaacatagaagaatccctgctaacggcatgattccattcctagaacctccagatgctcctaatggaccataaaaccttaattgtatcatatgtttagttgcaccctaaatctgggtgccaagattctgatgtcaccaaaaagcctcgataccatgggcagtgcagctcaagtccgcactataaattgtgcacccaaggagggcaaggtcctcagggaagtgtttctcttctgtgggaacaggactctgaaagtacatagagaactcatgcaggtcgcacgatcttccctaacacatctatgatcagggtggccaggacaaggaactccctagctctgagggaaatccaatttatttgtaagttcccagttcgaacctgcatcatcacacaggcctgttggatggtcccaacatatatgtgagtgaatgttctcagtcagaacctgagttatccatcacgcaggcctgtgggatggtctgcatcattgatcacacacctgtttcagtcatgttgcgtcatgacctcagcttcaattgacatagttattcaggtattttttttttttacacattccttgggcatcatctttctgaagactcactgttgcacctattaatctgacattgactaaatgagcaattctgggcacattaatttctttcacagtatggaggagcaacaccagggccttgcacatgcaaggcaagtagtgttctgctaagctccactcccagccctgtttgtgttaaacttgaaatacatttctggcaagacaaataacacattgaaagccacacctgaagagcactggctttttaaatgtttaatgtatgttcgatcagttaaaattgaacatcattacctgaattagattatctatattattttaagggcaaggagttttgcattccaaattttaaaatctgtttttcattgtccttctacttgactataaccccatagttggctttccatttacgtgtctctgtagttaggtatgactaactataaacaagctttgcttgtatgtttctattgaacttcaagatctgtgtggaaaccatcacacttaatgggagggtacaaatgtgctcagaaagtaaacagtggcccttaaatgcatcttgtgtcctcttcctcctctgcagagcactacccactacaagaaagaaatgaaagggcatgaattgcttcagacttcccaactttatctcaggggatgaaaaataagttttgtgtttctcgttaatcgatataggaaaaaggctaggcacttaagacttgtcctgatccagtggccaccatatactgataaaagtctaaagaccatggagacttggttccttaatcttaaatacattcttcaatgtttggcatttttatctatttgttactcaaatgtgttgctaattctcccattttttcttttgacaaattaagcctgttggagtaagctataaaacagacatatacatttccccccacttgctacaaaagatgtctttagacatagtattgagacatcccctccagatgacaggtttggccaggtgtggtatggaggcttaggtccatgtactaggatctcaaactcagaggtccaaggagtagccataccctgccttcctcacaagtctaaggggaaaaaattctctactgggagttttatagtcaggtaatgttttagccatttgaagtcagcacttagagttagattgcattgcccttgagagaaccaatgattattcatttctctgccataataaatgaattgttctttatttttcacatgtattaagcacaggtctgatgcaattatttaaggtataaaatactagaaaatgaaatgtaaagaatgggaaattatattttttgcatgaaaatagactgcttacaaatttgcttaatatctcaggacaaaagaatgaacagttgtatgtaaaattgataaataagttgtattttctttacagtttttattttaagaaaaccctacaatggggaagggggctgatagttttagggtctctcttaagtatgctacataatcctgcctgtgaatctacaaatcctcccatgagaatgagaccagctccatgtgaggaccagtccctgaacgagatcctcttcactgagaacacattagtggttgtactgcagaggcgatgaatactcgtaagaaagcgtttctaaacctagtcccagacatcaagggttttcacaaggtaacaatgccacggaagcactcatctctccactcattttacgtttctttgttaaatcattgcaatgattgcatggggaaggggaaatggctatttttttgaagaattgcttatcctactttcaatttttgaaaatcaaggaattaaaatattactttttaaatatgcatagatgtatcttaactgtaattatattttcatttgctttgttataacagcatgaacagcaaatacaaaatgcacttacagaaacttttgtaaaaaataaagattttttttatttctcaaaaaaaaaaaacgagctcttgc

SEQ ID NO: 277 - DNA, 2580 bp, Rat
gggctgcggggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatatt

SEQ ID NO: 278 - DNA, 1752 bp, Rat
ggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccacttttttttttctgcctgagattctttaaggagatagacgggttgaaagacatcaatgaaac

SEQ ID NO: 279 - DNA, 2514 bp, Rat
gggcctggccggcggagaacatggcgctgcccccggctgccgcaccccccggggctaacgagcctctcgacaaggctctgtccgcgttgccgccggagccgggcggtgtcccgctgcactcgccctggaccttctggctggacagatcactccctggtgccacagcagccgagtgtgcctcgaatctgaagaaaatctacacggtacaaacagtgcagatattctggagtgtatacaataacatccctcctgtgaccagcctgcctttgagatgtagttatcacttaatgagaggagagaggcgaccactttgggaggaggagagtaatgcgaagggtggcgtgtggaagatgaaagttcccaaggacagcacgtccacagtttggaaagaattgttgttagcgaccattggagagcagttcacagactgtgctgcagcagatgacgagatcatcggagtcagcgtgagtgtgcgggaccgagaggatgtcgtccaggtgtggaatgtcaacgcctcactagtgggcgaagcgactgtgctagagaagatccaccagctcctgccccacatagcttttaaagcagtgttttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagcccgatgctggtccatttagagtgggtttctgtccttgcaaaccgggccattaggactcaaagtggcaggtggggttggggaagaaggtgcgggtttctgccatcgtatcacttgctttaaagagaaagagtgagagaagaaagaaagaaagaaagaaagaaagaaagaaagaaagaaagaaagaaagaaagaaagaaagaaaagaaagaaagactttcttaaagctttccaaattctctgggtttttttgcactcttcccctccccataagattccttattcagggtaattattgttttctgcccaccctttcattgaggcataagagttgggtttccccttcagtgactctactgtaccttgttaaggaacatagccgccacaggactgcctgtgaagccacagggcaccaggaggaggcctagcctagcaaaaccctttttctgataaattgttgtgacacttccctgcatattgtgagctgggcattgtttcttttgtgtgtgtgttccgtagaaagcacactcaattgatagcacacacatcttaaaacccctttaaaaagcagtataaggaaaataaattgttggtttgcctaaaatgaaaactttaatcacaattgggtgtcaggctccaaatcaaactctaggttttgggggcctacagtgtaagtatttctaaccagaattccccctccccaccatatctgaccctttcaacaaaagacccaatgatttgtcctgagaggaaaccttctatttctgatttatagaggaggcgatgtgtattaattgtggggagtagagcttcttccatgttgcagcatgtttacccaaaccaattctcacatcttttgttaagtgagccggctttcctgcccctgtcacgtgtcctttctgaaaaccgatggccttcctgcagaggcgtctttcccctcatctgtgcacttacaggaagcacctagccactcacacagctgcccttgagtgcatctcattcctgtggactgtgttattcgatattggattatagtaccaaagaaatactgccttcagtagaagaaaacctttcagagcctcccagctcctcccagatgttccccggttccctctcatctttgccccacccctggtcattttccttcagaaagggcttctcccctgcgggcttgggtcagatccatgggccagtgtgcagcttctgttcttctcaaaagggcgaatttttaattccccttgcactgtgggaaggagaggtgaggttacactaagccttccacatgcatttgtaaataaaattcccattcagatatttcagatggctctcggtagcatctgtttataaaaagtcaggggcctccacttgcattgctaaacaggaagccaaattaattagtggtcagagcgtaagaggcgcttctttcccaaccttaagtccctccacggtttcactcatgaggggctcggatccttcttgtctcaatgacgtgcatttctctgaacagtttctaaacttgttttaaaactataactcaaggactttaaaacttactgtagacacaattcctttttataatataagtatttttttctgacagattagcacaaaggatataattgacttcaatattataattgtcatatgcatatatatatttccataagtaaataaattttgagaaaattttatttttgaactttatttaaagcatttgtgataacatgttcaaattttgcgtgtatgtagcttttgaagtaaaaataaaataaaataaatagg

SEQ ID NO: 280 - DNA, 1 bp, Place Holder
a

SEQ ID NO: 281 - DNA, 1 bp, Place Holder
a

SEQ ID NO: 282 - DNA, 1 bp, Place Holder
a

SEQ ID NO: 283 - DNA, 1 bp, Place Holder
a

SEQ ID NO: 284 - DNA, 1 bp, Place Holder
a

SEQ ID NO: 285 - DNA, 1 bp, Place holder
a

SEQ ID NO: 286 - DNA, 1 bp, Place Holder
a

SEQ ID NO: 287 - DNA, 1 bp, Place holder
a

SEQ ID NO: 288 - DNA, 1 bp, Place holder
a

SEQ ID NO: 289 - DNA, 1 bp, Place holder
a

SEQ ID NO: 290 - DNA, 1 bp, Place holder
a

SEQ ID NO: 291 - DNA, 1 bp, Place holder
a

SEQ ID NO: 292 - DNA, 1 bp, Place holder
a

SEQ ID NO: 293 - DNA, 1 bp, Place holder
a

SEQ ID NO: 294 - DNA, 1 bp, Place holder
a

SEQ ID NO: 295 - DNA, 1 bp, Place holder
a

SEQ ID NO: 296 - DNA, 1 bp, Place holder
a

SEQ ID NO: 297 - DNA, 1 bp, Place holder
a

SEQ ID NO: 298 - DNA, 1 bp, Place holder
a

SEQ ID NO: 299 - DNA, 1 bp, Place holder
a

SEQ ID NO: 300 - DNA, 1 bp, Place holder
a

SEQ ID NO: 301 - DNA, 1 bp, Place holder
a

SEQ ID NO: 302 - DNA, 1 bp, Place holder
a

SEQ ID NO: 303 - DNA, 1 bp, Place holder
a

SEQ ID NO: 304 - DNA, 1 bp, Place holder
a

SEQ ID NO: 305 - DNA, 1 bp, Place holder
a

SEQ ID NO: 306 - DNA, 1 bp, Place holder
a

SEQ ID NO: 307 - DNA, 1 bp, Place holder
a

SEQ ID NO: 308 - DNA, 1 bp, Place holder
a

SEQ ID NO: 309 - DNA, 1 bp, Place holder
a

SEQ ID NO: 310 - DNA, 1 bp, Place holder
a

SEQ ID NO: 311 - DNA, 1 bp, Place holder
a

SEQ ID NO: 312 - DNA, 1 bp, Place holder
a

SEQ ID NO: 313 - DNA, 1 bp, Place holder
a

SEQ ID NO: 314 - DNA, 1 bp, place holder
a

SEQ ID NO: 315 - DNA, 1 bp, Place holder
a

SEQ ID NO: 316 - DNA, 1 bp, Place holder
a

SEQ ID NO: 317 - DNA, 1 bp, Place holder
a

SEQ ID NO: 318 - DNA, 1 bp, Place holder
a

SEQ ID NO: 319 - DNA, 1 bp, Place holder
a

SEQ ID NO: 320 - DNA, 1 bp, Place holder
a

SEQ ID NO: 321 - DNA, 1 bp, Place holder
a

SEQ ID NO: 322 - DNA, 1 bp, Place holder
a

SEQ ID NO: 323 - DNA, 1 bp, Place holder
a

SEQ ID NO: 324 - DNA, 1 bp, Place holder
a

SEQ ID NO: 325 - DNA, 1 bp, Place holder
a

SEQ ID NO: 326 - DNA, 1 bp, Place holder
a

SEQ ID NO: 327 - DNA, 1 bp, Place holder
a

SEQ ID NO: 328 - DNA, 1 bp, Place holder
a

SEQ ID NO: 329 - DNA, 1 bp, Place holder
a

SEQ ID NO: 330 - DNA, 1 bp, Place holder
a

SEQ ID NO: 331 - DNA, 1 bp, Place holder
a

SEQ ID NO: 332 - DNA, 1 bp, Place holder
a

SEQ ID NO: 333 - DNA, 1 bp, Place holder
a

SEQ ID NO: 334 - DNA, 1 bp, Place holder
a

SEQ ID NO: 335 - DNA, 1 bp, Place holder
a

SEQ ID NO: 336 - DNA, 1 bp, Place holder
a

SEQ ID NO: 337 - DNA, 1 bp, Place holder
a

SEQ ID NO: 338 - DNA, 1 bp, Place holder
a

SEQ ID NO: 339 - DNA, 1 bp, Place holder
a

SEQ ID NO: 340 - DNA, 1 bp, Place holder
a

SEQ ID NO: 341 - DNA, 1 bp, Place holder
a

SEQ ID NO: 342 - DNA, 1 bp, Place holder
a

SEQ ID NO: 343 - DNA, 1 bp, Place holder
a

SEQ ID NO: 344 - DNA, 1 bp, Place holder
a

SEQ ID NO: 345 - DNA, 1 bp, Place holder
a

SEQ ID NO: 346 - DNA, 1 bp, Place holder
a

SEQ ID NO: 347 - DNA, 1 bp, Place holder
a

SEQ ID NO: 348 - DNA, 1 bp, Place holder
a

SEQ ID NO: 349 - DNA, 1 bp, Place holder
a

SEQ ID NO: 350 - DNA, 1 bp, Place holder
a

SEQ ID NO: 351 - DNA, 1 bp, Place holder
a

SEQ ID NO: 352 - DNA, 1 bp, Place holder
a

SEQ ID NO: 353 - DNA, 1 bp, Place holder
a

SEQ ID NO: 354 - DNA, 1 bp, Place holder
a

SEQ ID NO: 355 - DNA, 1 bp, Place holder
a

SEQ ID NO: 356 - DNA, 1 bp, Place holder
a

SEQ ID NO: 357 - DNA, 1 bp, Place holder
a

SEQ ID NO: 358 - DNA, 1 bp, Place holder
a

SEQ ID NO: 359 - DNA, 1 bp, Place holder
a

SEQ ID NO: 360 - DNA, 1 bp, Place holder
a

SEQ ID NO: 361 - DNA, 1 bp, Place holder
a

SEQ ID NO: 362 - DNA, 1 bp, Place holder
a

SEQ ID NO: 363 - DNA, 1 bp, Place holder
a

SEQ ID NO: 364 - DNA, 1 bp, Place holder
a

SEQ ID NO: 365 - DNA, 1 bp, Place holder
a

SEQ ID NO: 366 - DNA, 1 bp, Place holder
a

SEQ ID NO: 367 - DNA, 1 bp, Place holder
a

SEQ ID NO: 368 - DNA, 1 bp, Place holder
a

SEQ ID NO: 369 - DNA, 1 bp, Place holder
a

SEQ ID NO: 370 - DNA, 1 bp, Place holder
a

SEQ ID NO: 371 - DNA, 1 bp, Place holder
a

SEQ ID NO: 372 - DNA, 1 bp, Place holder
a

SEQ ID NO: 373 - DNA, 1 bp, Place holder
a

SEQ ID NO: 374 - DNA, 1 bp, Place holder
a

SEQ ID NO: 375 - DNA, 1 bp, Place holder
a

SEQ ID NO: 376 - DNA, 1 bp, Place holder
a

SEQ ID NO: 377 - DNA, 1 bp, Place holder
a

SEQ ID NO: 378 - DNA, 1 bp, Place holder
a

SEQ ID NO: 379 - DNA, 1 bp, Place holder
a

SEQ ID NO: 380 - DNA, 1 bp, Place holder
a

SEQ ID NO: 381 - DNA, 1 bp, Place holder
a

SEQ ID NO: 382 - DNA, 1 bp, Place holder
a

SEQ ID NO: 383 - DNA, 1 bp, Place holder
a

SEQ ID NO: 384 - DNA, 1 bp, Place holder
a

SEQ ID NO: 385 - DNA, 1 bp, Place holder
a

SEQ ID NO: 386 - DNA, 1 bp, Place holder
a

SEQ ID NO: 387 - DNA, 1 bp, Place holder
a

SEQ ID NO: 388 - DNA, 1 bp, Place holder
a

SEQ ID NO: 389 - DNA, 1 bp, Place holder
a

SEQ ID NO: 390 - DNA, 1 bp, Place holder
a

SEQ ID NO: 391 - DNA, 1 bp, Place holder
a

SEQ ID NO: 392 - DNA, 1 bp, Place holder
a

SEQ ID NO: 393 - DNA, 1 bp, Place holder
a

SEQ ID NO: 394 - DNA, 1 bp, Place holder
a

SEQ ID NO: 395 - DNA, 1 bp, Place holder
a

SEQ ID NO: 396 - DNA, 1 bp, Place holder
a

SEQ ID NO: 397 - DNA, 1 bp, Place holder
a

SEQ ID NO: 398 - DNA, 1 bp, Place holder
a

SEQ ID NO: 399 - DNA, 1 bp, Place holder
a

SEQ ID NO: 400 - DNA, 1 bp, Place holder
a

SEQ ID NO: 401 - DNA, 1 bp, Place holder
a

SEQ ID NO: 402 - DNA, 1 bp, Place holder
a

SEQ ID NO: 403 - DNA, 1 bp, Place holder
a

SEQ ID NO: 404 - DNA, 1 bp, Place holder
a

SEQ ID NO: 405 - DNA, 1 bp, Place holder
a

SEQ ID NO: 406 - DNA, 1 bp, Place holder
a

SEQ ID NO: 407 - DNA, 1 bp, Place holder
a

SEQ ID NO: 408 - DNA, 1 bp, Place holder
a

SEQ ID NO: 409 - DNA, 1 bp, Place holder
a

SEQ ID NO: 410 - DNA, 1 bp, Place holder
a

SEQ ID NO: 411 - DNA, 1 bp, Place holder
a

SEQ ID NO: 412 - DNA, 1 bp, Place holder
a

SEQ ID NO: 413 - DNA, 1 bp, Place holder
a

SEQ ID NO: 414 - DNA, 1 bp, Place holder
a

SEQ ID NO: 415 - DNA, 1 bp, Place holder
a

SEQ ID NO: 416 - DNA, 1 bp, Place holder
a

SEQ ID NO: 417 - DNA, 1 bp, Place holder
a

SEQ ID NO: 418 - DNA, 1 bp, Place holder
a

SEQ ID NO: 419 - DNA, 1 bp, Place holder
a

SEQ ID NO: 420 - DNA, 1 bp, Place holder
a

SEQ ID NO: 421 - DNA, 1 bp, Place holder
a

SEQ ID NO: 422 - DNA, 1 bp, Place holder
a

SEQ ID NO: 423 - DNA, 1 bp, Place holder
a

SEQ ID NO: 424 - DNA, 1 bp, Place holder
a

SEQ ID NO: 425 - DNA, 1 bp, Place holder
a

SEQ ID NO: 426 - DNA, 1 bp, Place holder
a

SEQ ID NO: 427 - DNA, 1 bp, Place holder
a

SEQ ID NO: 428 - DNA, 1 bp, Place holder
a

SEQ ID NO: 429 - DNA, 1 bp, Place holder
a

SEQ ID NO: 430 - DNA, 1 bp, Place holder
a

SEQ ID NO: 431 - DNA, 1 bp, Place holder
a

SEQ ID NO: 432 - DNA, 1 bp, Place holder
a

SEQ ID NO: 433 - DNA, 1 bp, Place holder
a

SEQ ID NO: 434 - DNA, 1 bp, Place holder
a

SEQ ID NO: 435 - DNA, 1 bp, Place holder
a

SEQ ID NO: 436 - DNA, 1 bp, Place holder
a

SEQ ID NO: 437 - DNA, 1 bp, Place holder
a

SEQ ID NO: 438 - DNA, 1 bp, Place holder
a

SEQ ID NO: 439 - DNA, 1 bp, Place holder
a

SEQ ID NO: 440 - DNA, 1 bp, Place holder
a

SEQ ID NO: 441 - DNA, 1 bp, Place holder
a

SEQ ID NO: 442 - DNA, 1 bp, Place holder
a

SEQ ID NO: 443 - DNA, 1 bp, Place holder
a

SEQ ID NO: 444 - DNA, 1 bp, Place holder
a

SEQ ID NO: 445 - DNA, 1 bp, Place holder
a

SEQ ID NO: 446 - DNA, 1 bp, Place holder
a

SEQ ID NO: 447 - DNA, 1 bp, Place holder
a

SEQ ID NO: 448 - DNA, 1 bp, Place holder
a

SEQ ID NO: 449 - DNA, 1 bp, Place holder
a

SEQ ID NO: 450 - DNA, 1 bp, Place holder
a

SEQ ID NO: 451 - DNA, 1 bp, Place holder
a

SEQ ID NO: 452 - DNA, 1 bp, Place holder
a

SEQ ID NO: 453 - DNA, 1 bp, Place holder
a

SEQ ID NO: 454 - DNA, 1 bp, Place holder
a

SEQ ID NO: 455 - DNA, 1 bp, Place holder
a

SEQ ID NO: 456 - DNA, 1 bp, Place holder
a

SEQ ID NO: 457 - DNA, 1 bp, Place holder
a

SEQ ID NO: 458 - DNA, 1 bp, Place holder
a

SEQ ID NO: 459 - DNA, 1 bp, Place holder
a

SEQ ID NO: 460 - DNA, 1 bp, Place holder
a

SEQ ID NO: 461 - DNA, 1 bp, Place holder
a

SEQ ID NO: 462 - DNA, 1 bp, Place holder
a

SEQ ID NO: 463 - DNA, 1 bp, Place holder
a

SEQ ID NO: 464 - DNA, 1 bp, Place holder
a

SEQ ID NO: 465 - DNA, 1 bp, Place holder
a

SEQ ID NO: 466 - DNA, 1 bp, Place holder
a

SEQ ID NO: 467 - DNA, 1 bp, Place holder
a

SEQ ID NO: 468 - DNA, 1 bp, Place holder
a

SEQ ID NO: 469 - DNA, 1 bp, Place holder
a

SEQ ID NO: 470 - DNA, 1 bp, Place holder
a

SEQ ID NO: 471 - DNA, 1 bp, Place holder
a

SEQ ID NO: 472 - DNA, 1 bp, Place holder
a

SEQ ID NO: 473 - DNA, 1 bp, Place holder
a

SEQ ID NO: 474 - DNA, 1 bp, Place holder
a

SEQ ID NO: 475 - DNA, 1 bp, Place holder
a

SEQ ID NO: 476 - DNA, 1 bp, Place holder
a

SEQ ID NO: 477 - DNA, 1 bp, Place holder
a

SEQ ID NO: 478 - DNA, 1 bp, Place holder
a

SEQ ID NO: 479 - DNA, 1 bp, Place holder
a

SEQ ID NO: 480 - DNA, 1 bp, Place holder
a

SEQ ID NO: 481 - DNA, 1 bp, Place holder
a

SEQ ID NO: 482 - DNA, 1 bp, Place holder
a

SEQ ID NO: 483 - DNA, 1 bp, Place holder
a

SEQ ID NO: 484 - DNA, 1 bp, Place holder
a

SEQ ID NO: 485 - DNA, 1 bp, Place holder
a

SEQ ID NO: 486 - DNA, 1 bp, Place holder
a

SEQ ID NO: 487 - DNA, 1 bp, Place holder
a

SEQ ID NO: 488 - DNA, 1 bp, Place holder
a

SEQ ID NO: 489 - DNA, 1 bp, Place holder
a

SEQ ID NO: 490 - DNA, 1 bp, Place holder
a

SEQ ID NO: 491 - DNA, 1 bp, Place holder
a

SEQ ID NO: 492 - DNA, 1 bp, Place holder
a

SEQ ID NO: 493 - DNA, 1 bp, Place holder
a

SEQ ID NO: 494 - DNA, 1 bp, Place holder
a

SEQ ID NO: 495 - DNA, 1 bp, Place holder
a

SEQ ID NO: 496 - DNA, 1 bp, Place holder
a

SEQ ID NO: 497 - DNA, 1 bp, Place holder
a

SEQ ID NO: 498 - DNA, 1 bp, Place holder
a

SEQ ID NO: 499 - DNA, 1 bp, Place holder
a

SEQ ID NO: 500 - DNA, 1 bp, Place holder
a

SEQ ID NO: 501 - protein, 1030 aa, Mus musculus
MSASGDGTRVPPKSKGKTLSSFFGSLPGFSSARNLVSHTHSSTSTKDLQTATDPSGTPAPSSKVSTNSQMAGDAAGLLQPSEQTAGDKDMGSFSVTSSEDAFSGVFGIMDAAKGMVQGGLGATQSALVGTKEAVSGGVMGAVGVAKGLVKGGLDTSKNVLTNTKDTVTTGVMGAANMAKGTVQTGLDTTKSVVMGTKDTVATGLAGAVNVAKGTIQGGLDTTKSVVMGTKDTVTTGLTGAANVAKGVVQGGLDTTKSVVMGTKDTVTTGLTGAMNVAKGTAQMGIDTSKTVLTGTKDTVCAGATGAINVAKGAAQGGLDTTKSVLIGTKDTVTTGLTGAVNVAKGAVQGGLDTTKSVVMGTKDTVTTGLTGAMNVAKGTAQMGLGTSKTVLTGTKDTVCAGLTGAINVAKGAAQGGLDTTKSVLMGTKDTVTTGLTGAVNVAKGTIQGGLDTTKSVVMGTKDTVTTGLTGAVNVAKGTIQGGLDTTKSVVMGTKDTVTTGLTGAVNVAKGAAQGGLDTTKSVVMGTKDTVTTGLTGAMNVAKGTAQMGLGTSKTVLTGTKDTVCAGLTGAINVAKGAAQGGLDTTKSVLMGTKDTVTTGLTGAVNVAKGTIQGGLDTTKSVVMGTKDTVTTGLTGAVNVAKGAVQGGLDTTKSVVMGTKDTVTTGLTGALNVAKGTAQMGIDTSKTVLIGTKDTVCAGATGAINMAKGAAQGGLDTTKSVLMGTKDTVTTGLTGAINVAKGSAQGGLDTTKSVLIGTKDTVTTGLTGALNVAKGTVQTGLDTSQRVLTGTKDNVYAGVTGAVNVAKGTIQGGLDTTKSVVMGTKDTVTTGLTGAVNVAKGAVQGGLDTTKSVVMGTKDTVTTGLTGAMNVAKGTAQMGIDTSKTVLTGTKDTVCAGLTGAINVAKGATQGGLDTTKSVLMGTKDTVTTGLTGAINVAKGAAQGGLDTTKSVLLGTKDTVTTGLTGAANVAKETVQMGLDTSKNILMDTKDSICAGATGAITVVKGAAQGGLDTSNAALTGTMDTAKGTVQ

SEQ ID NO: 502 - protein, 450 aa, Homo sapiens
MAEQTFSSAFSAAQFAETKGTAVLRVLKGTAVLHVLTGTTVLHVLKGTAVLHVLKGTAILQVLTGTAVLHVLKGTAVLHVLKGTAVLQVLTGTAVLHVLKGTAVLHVLTGTTVLHVLKGTAVLHVLKGTAILQVLTGTAVLHVLKGTAVLHVLKGTAVLQVLTGTAVLHVLKGTAVLHVLTGTAVLHVLKGTAVRCMLKGTAVLHILKGTAVLHVLKGTAVLHVLKGTAVLHVLTGTAVLHVLKGTAVLQVLTGTAILHVLKGTAVLHVLKGTAVRCMLKGTAVLHILKGTAVLQVLTGTAVLHVLKGTAVLHVLKGTAVLQVLTGTAVLQVLKGTAVLHVLKGTAVLHVLKGTAVLQVLTGTAVLHVLKGTAVLHVLKGTAVRCMLKGTAALHSFKVTAALHGLTAPPVSTCSQGTTTLHPLKVTAALHTQGTQDSHRWSFFSLRGKAK

SEQ ID NO: 503 - protein, 439 aa, Homo sapiens
MTVYCCRLYTHCTRRLLRLLGGRSGALAWSWKRVQDTHRVQPGHRRSLRAHGHCHFSPLKGTAVLRVLKGTAVLHVLTGTTVLHVLKGTAVLHVLKGTAILQVLTGTAVLHVLKGTVVLHVLKGTAVLHMLKGTAVLQVLTGTAVLHVLKGTAVLHVLKGTAVLQVLTGTAVLHVLKGTAVRCMLKGTAVLHILKGTAVLHVLKGTAVLHVLKGTAVLQVLTGTAILHVLKGTAVLHVLKGTAVRCMLKGTAVLHILKGTAVLQVLTGTAVLHVLKGTAVLHVLKGTAVLQVLTGTAVLQVLKGTAVLHVLKGTAVLHVLKGTAVLQVLTGTAVLHVLKGTAVLHVLKGTAVRCMLKGTAALHSFKVTAALHGLTAPPVSTCSQGTTTLHPLKVTAALHTQGTQDSHRWSFFSLRGKAKAPPILGPWSTWSTVQCELCL

SEQ ID NO: 504 - protein, 55 aa, mus musculus
MVPKVAAASAELLIIGWYIFRVLLQVFRYSLQKLAHTVSRTGRQVLGERRQRAPN

SEQ ID NO: 505 - protein, 81 aa, Homo sapiens
MAAVAAASAELLIIGWYIFRVLLQVFLECCIYWVGFAFRNPPGTQPIARSEVFRYSLQKLAYTVSRTGRQVLGERRQRAPN

SEQ ID NO: 506 - protein, 54 aa, Mus musculus
MAAVAAASAELLIIGWYIFRVLLQVFRYSLQKLAHTVSRTGRQVLGERRQRAPN

SEQ ID NO: 507 - protein, 54 aa, Homo sapiens
MAAVAAASAELLIIGWYIFRVLLQVFRYSLQKLAYTVSRTGRQVLGERRQRAPN

SEQ ID NO: 508 - protein, 81 aa, Mus musculus
MAAVAAASAELLIIGWYIFRVLLQVFLECCIYWVGFAFRNPPGTQPIARSEVFRYSLQKLAHTVSRTGRQVLGERRQRAPN

SEQ ID NO: 509 - protein, 81 aa, Homo sapiens; identical to SEQ ID NO: 505

SEQ ID NO: 510 - protein, 765 aa, Mus musculus
MTQKTTLVLLALAVITIFALVCVLLAGRSGDGGGLSQPLHCPSVLPSVQPRTHPSQSQPFADLSPEELTAVMSFLTKHLGPGLVDAAQARPSDNCVFSVELQLPAKAAALAHLDRGGPPPVREALAIIFFGGQPKPNVSELVVGPLPHPSYMRDVTVERHGGPLPYYRRPVLDREYQDIEEMIFHRELPQASGLLHHCCFYKHQGQNLLTMTTAPRGLQSGDRATWFGLYYNLSGAGFYPHPIGLELLIDHKALDPALWTIQKVFYQGRYYESLTQLEDQFEAGLVNVVLVPNNGTGGSWSLKSSVPPGPAPPLQFHPQGPRFSVQGSQVSSSLWAFSFGLGAFSGPRIFDIRFQGERVAYEISVQEAIALYGGNSPASMSTCYVDGSFGIGKYSTPLIRGVDCPYLATYVDWHFLLESQAPKTLRDAFCVFEQNQGLPLRRHHSDFYSHYFGGVVGTVLVVRSVSTLLNYDYIWDMVFHPNGAIEVKFHATGYISSAFFFGAGEKFGNRVGAHTLGTVHTHSAHFKVDLDVAGLKNWAWAEDMAFVPTIVPWQPEYQMQRLQVTRKLLETEEEAAFPLGGATPRYLYLASNHSNKWGHRRGYRIQILSFAGKPLPQESPIEKAFTWGRYHLAVTQRKEEEPSSSSIFNQNDPWTPTVNFTDFISNETIAGEDLVAWVTAGFLHIPHAEDIPNTVTAGNSVGFFLRPYNFFDEDPSFHSADSIYFREGQDATACEVNPLACLSQTATCAPEIPAFSHGGFAYRDN

SEQ ID NO: 511 - protein, 763 aa, Homo sapiens
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 512 - DNA, 1 bp, Place holder
a

SEQ ID NO: 513 - protein, 164 aa, Homo sapiens
MLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 514 - DNA, 1 bp, Place holder
a

SEQ ID NO: 515 - protein, 60 aa, Mus musculus
MVRRDRLRRMREWWVQVGLLAVPLLAAYLHIPPPQLSPALHSWKTSGKFFTYKGLRIFYQ

SEQ ID NO: 516 - protein, 335 aa, Homo sapiens [sequence omitted]

SEQ ID NO: 517 - protein, 336 aa, Mus musculus
MRYLPWLLLWAFLQVWGQSEAQQKNYTFRCLQMSSFANRSWSRTDSVVWLGDLQTHRWSNDSATISFTKPWSQGKLSNQQWEKLQHMFQVYRVSFTRDIQELVKMMSPKEDYPIEIQLSAGCEMYPGNASESFLHVAFQGKYVVRFWGTSWQTVPGAPSWLDLPIKVLNADQGTSATVQMLLNDTCPLFVRGLLEAGKSDLEKQEKPVAWLSSVPSSADGHRQLVCHVSGFYPKPVWVMCMRGDQEQQGTHRGDFLPNADETWYLQATLDVEAGEEAGLACRVKHSSLGGQDIILYWDARQAPVGLIVFIVLIMLVVVGAVVYYIWRRRSAYQDIR

SEQ ID NO: 518 - protein, 335 aa, Homo sapiens
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 519 - protein, 123 aa, Mus musculus
MDVFKKGFSIAKEGVVGAVEKTKQGVTEAAEKTKEGVMYVGTKTKENVVQSVTSVAEKTKEQANAVSEAVVSSVNTVANKTVEEAENIVVTTGVVRKEDLEPPAQDQEAKEQEENEEAKSGED

SEQ ID NO: 520 - protein, 127 aa, Homo sapiens
MDVFKKGFSIAKEGVVDAVEKTKQGVTEAAEKTKEGVMYVGAKTKENVVQSVTSVAEKTKEQANAVSEAVVSSVNTVATKTVEEAENIAVTSGVVRKEDLRPSAPQQEGEASKEKEEVAEEAQSGGD

SEQ ID NO: 521 - protein, 219 aa, Mus musculus
MGMSSLKLLKYVLFIFNLLFWVCGCCILGFGIYFLVQNTYGVLFRNLPFLTLGNILVIVGSIIMVVAFLGCMGSIKENKCLLMSFFVLLLIILLAEVTIAILLFVYEQKLNTLVAEGLNDSIQHYHSDNSTMKAWDFIQTQLQCCGVNGSSDWTSGPPSSCPSGADVQGCYNKAKSWFHSNFLYIGIITICVCVIQVLGMSFALTLNCQIDKTSQALGL

SEQ ID NO: 522 - protein, 219 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIEVLGMSFALTLNCQIDKTSQTIGL

SEQ ID NO: 523 - protein, 422 aa, Mus musculus
MLQWRRRHCCFAKMTWSPKRSLLRTPLTGVLSLVFLFAMFLFFNHHDWLPGRPGFKENPVTYTFRGFRSTKSETNHSSLRTIWKEVAPQTLRPHIASNSSNTELSPQGVTGLQNTLSANGSIYNEKGTGHPNSYHFKYIINEPEKCQEKSPFLILLIAAEPGQIEARRAIRQTWGNETLAPGIQIIRVFLLGISIKLNGYLQHAIQEESRQYHDIIQQEYLDTYYNLTIKTLMGMNWVATYCPHTPYVMKTDSDMFVNTEYLIHKLLKPDLPPRHNYFTGYLMRGYAPNRNKDSKWYMPPDLYPSERYPVFCSGTGYVFSGDLAEKIFKVSLGIRRLHLEDVYVGICLAKLRVDPVPPPNEFVFNHWRVSYSSCKYSHLITSHQFQPSELIKYWNHLQQNKHNACANAAKEKAGRYRHRKLH

SEQ ID NO: 524 - protein, 422 aa, Homo sapiens
MLQWRRRHCCFAKMTWNAKRSLFRTHLIGVLSLVFLFAMFLFFNHHDWLPGRAGFKENPVTYTFRGFRSTKSETNHSSLRNIWKETVPQTLRPQTATNSNNTDLSPQGVTGLENTLSANGSIYNEKGTGHPNSYHFKYIINEPEKCQEKSPFLILLIAAEPGQIEARRAIRQTWGNESLAPGIQITRIFLLGLSIKLNGYLQRAILEESRQYHDIIQQEYLDTYYNLTIKTLMGMNWVATYCPHIPYVMKTDSDMFVNTEYLINKLLKPDLPPRHNYFTGYLMRGYAPNRNKDSKWYMPPDLYPSERYPVFCSGTGYVFSGDLAEKIFKVSLGIRRLHLEDVYVGICLAKLRIDPVPPPNEFVFNHWRVSYSSCKYSHLITSHQFQPSELIKYWNHLQQNKHNACANAAKEKAGRYRHRKLH

SEQ ID NO: 525 - protein, 201 aa, Mus musculus
MEWVWALVLLAALGGGSAERDCRVSSFRVKENFDKARFSGLWYAIAKKDPEGLFLQDNIIAEFSVDEKGHMSATAKGRVRLLSNWEVCADMVGTFTDTEDPAKFKMKYWGVASFLQRGNDDHWIIDTDYDTFALQYSCRLQNLDGTCADSYSFVFSRDPNGLSPETRRLVRQRQEELCLERQYRWIEHNGYCQSRPSRNSL

SEQ ID NO: 526 - protein, 199 aa, Homo sapiens
MKWVWALLLLAAWAAAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 527 - protein, 741 aa, Mus musculus
MIHMLNAAAYRVKWTRSGAAKRAACLVAAAYALKTLYPIIGKRLKQPGHRKAKAEAYSPAENREILHCTEIICKKPAPGLNAAFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFANQTYYKVINMDGRLANPDQSLTEDIMMFSQSVAHLYSNLTKPILDVILTSYTLIRTATSRGASPIGPTLLAGLVVYATAKVLKACSPKFGSLVAEEAHRKGYLRYVHSRIIANVEEIAFYRGHKVEMKQLQKCYKALAYQMNLILSKRLWYIMIEQFLMKYVWSSCGLIMVAIPIITATGFADGDLEDGPKQAMVSDRTEAFTTARNLLASGADAIERIMSSYKEITELAGYTARVYNMFWVFDEVKRGIYKRTVTQEPENHSKRGGNLELPLSDTLAIKGTVIDVDHGIICENVPIITPAGEVVASRLNFKVEEGMHLLITGPNGCGKSSLFRILSGLWPVYEGVLYKPPPQHMFYIPQRPYMSLGSLRDQVIYPDSADDMREKGYTDQDLERILHSVHLYHIVQREGGWDAVMDWKDVLSGGEKQRMGMARMFYHKPKYALLDECTSAVSIDVEGKIFQAAIGAGISLLSITHRPSLWKYHTHLLQFDGEGGWRFEQLDTAIRLTLSEEKQKLESQLAGIPKMQQRLNELCKILGEDSVLKTIQTPEKTS

SEQ ID NO: 528 - protein, 740 aa, Homo sapiens
MTHMLNAAADRVKWTRSSAAKRAACLVAAAYALKTLYPIIGKRLKQSGHGKKKAAAYPAAENTEILHCTETICEKPSPGVNADFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFTNQTYYKVINMDGRLANPDQSLTEDIMMFSQSVAHLYSNLTKPILDVMLTSYTLIQTATSRGASPIGPTLLAGLVVYATAKVLKACSPKFGKLVAEEAHRKGYLRYVHSRIIANVEEIAFYRGHKVEMKQLQKSYKALADQMNLILSKRLWYIMIEQFLMKYVWSSSGLIMVAIPIITATGFADGEDGQKQVMVSERTEAFTTARNLLASGADAIERIMSSYKEVTELAGYTARVYNMFWVFDEVKRGIYKRTAVIQESESHSKNGAKVELPLSDTLAIKGKVIDVDHGIICENVPIITPAGEVVASRLNFKVEEGMHLLITGPNGCGKSSLFRILSGLWPVYEGVLYKPPPQHMFYIPQRPYMSLGSLRDQVIYPDSVDDMHDKGYTDQDLERILHNVHLYHIVQREGGWDAVMDWKDVLSGGEKQRMGMARMFYHKPKYALLDECTSAVSIDVEGKIFQAAKGAGISLLSITHRPSLWKYHTHLLQFDGEGGWRFEQLDTAIRLTLSEEKQKLESQLAGIPKMQQRLNELCKILGEDSVLKTIKNEDETS

SEQ ID NO: 529 - protein, 116 aa, Mus musculus
MRNSKTAISFFILVAVLGSQAGLIQEMEKEDRRYNPPIIHQGFQDTSSDCCFSYATQIPCKRFIYYFPTSGGCIKPGIIFISRRGTQVCADPSDRRVQRCLSTLKQGPRSGNKVIA

SEQ ID NO: 530 - protein, 718 aa, Mus musculus
MKLLLALAGLLAPLAMLQTSNGATPALLGEVENSVVLSCMEEAKQLVDRAYKERRESIKRTLQSGSASPTELLFYFKQPVAGTRTAVRAADYLHVALDLLKRKLQPLWPRPFNVTDVLTPAQLNLLSVSSGCAYQDVGVTCPPNDKYRTITGHCNNRRSPTLGASNRAFVRWLPAEYEDGVSMPFGWTPGVNRNGFKVPLARQVSNAIVRFPNDQLTKDQERALMFMQWGQFLDHDITLTPEPATRFSFFTGLNCETSCLQQPPCFPLKIPPNDPRIKNQKDCIPFFRSCPACTRNNITIRNQINALTSFVDASGVYGSEDPLARKLRNLTNQLGLLAVNTRFQDNGRALMPFDSLHDDPCLLTNRSARIPCFLAGDMRSSEMPELTSMHTLFVREHNRLATQLKRLNPRWNGEKLYQEARKIVGAMVQIITYRDYLPLVLGPAAMKKYLPQYRSYNDSVDPRIANVFTNAFRYGHTLIQPFMFRLNNQYRPTAANPRVPLSKVFFASWRVVLEGGIDPILRGLMATPAKLNRQNQIVVDEIRERLFEQVMRIGLDLPALNMQRSRDHGLPGYNAWRRFCGLPQPSTVGELGTVLKNLELARKLMAQYGTPNNIDIWMGGVSEPLEPNGRVGQLLACLIGTQFRKLRDGDRFWWENPGVFSKQQRQALASISLPRLICDNTGITTVSKNNIFMSNTYPRDFVSCNTLPKLNLTSWKET

SEQ ID NO: 531 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 532 - protein, 461 aa, Mus musculus
MSRQVVRSSKFRHVFGQPAKADQCYEDVRVSQTTWDSGFCAVNPKFMALICEASGGGAFLVLPLGKTGRVDKNVPLVCGHTAPVLDIAWCPHNDNVIASGSEDCTVMVWEIPDGGLVLPLREPVITLEGHTKRVGIVAWHPTAQNVLLSAGCDNVILVWDVGTGAAVLTLGPDVHPDTIYSVDWSRDGALICTSCRDKRVRVIEPRKGTVVAEKDRPHEGTRPVHAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERKCEPIAMTVPRKSDLFQEDLYPPTAGPDPALTAEEWLGGRDAGPLLISLKDGYVPPKSRELRVNRGLDSARRRATPEPSGTPSSDTVSRLEEDVRNLNAIVQKLQERLDRLEETVQAK

SEQ ID NO: 533 - protein, 461 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 534 - protein, 591 aa, Mus musculus
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 535 - protein, 384 aa, Homo sapiens
MRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELTGPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 536 - protein, 91 aa, Mus musculus
MKISAAALTIILTAAALCTPAPASPYGSDTTPCCFAYLSLALPRAHVKEYFYTSSKCSNLAVVFVTRRNRQVCANPEKKWVQEYINYLEMS

SEQ ID NO: 537 - protein, 91 aa, Homo sapiens
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 538 - protein, 598 aa, Mus musculus
PRDMIDDAFARAFAVWGEVAPLTFTRVYGPEADIVIQFGVAEHGDGYPFDGKDGLLAHAFPPGAGVQGDAHFDDDELWSLGKGVVIPTYYGNSNGAPCHFPFTFEGRSYSACTTDGRNDGTPWCSTTADYDKDGKFGFCPSERLYTEHGNGEGKPCVFPFIFEGRSYSACTTKGRSDGYRWCATTANYDQDKLYGFCPTRVDATVVGGNSAGELCVFPFVFLGKQYSSCTSDGRRDGRLWCATTSNFDTDKKWGFCPDQGYSLFLVAAHEFGHALGLDHSSVPEALMYPLYSYLEGFPLNKDDIDGIQYLYGRGSKPDPRPPATTTTEPQPTAPPTMCPTIPPTAYPTVGPTVGPTGAPSPGPTSSPSPGPTGAPSPGPTAAPTAGSSEASTESLSPADNPCNVDVFDAIAEIQGALHFFKDGWYWKFLNHRGSPLQGPFLTARTWPALPATLDSAFEDPQTKRVFFFSGRQMWVYTGKTVLGPRSLDKLGLGPEVTHVSGLLPRRPGKALLFSKGRVWRFDLKSQKVDPQSVIRVDKEFSGVPWNSHDIFQYQDKAYFCHGKFFWRVSFQNEVNKVDPEVNQVDDVGYVTYDLLQCP

SEQ ID NO: 539 - protein, 707 aa, Homo sapiens
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 540 - DNA, 1 bp, Place holder
a

SEQ ID NO: 541 - protein, 1256 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 542 - protein, 419 aa, Mus musculus
MSPLLLLLLCLLLGNLEPEEAKLIRVPLQRIHLGHRILNPLNGWEQLAELSRTSTSGGNPSFVPLSKFMNTQYFGTIGLGTPPQNFTVVFDTGSSNLWVPSTRCHFFSLACWFHHRFNPKASSSFRPNGTKFAIQYGTGRLSGILSQDNLTIGGIHDAFVTFGEALWEPSLIFALAHFDGILGLGFPTLAVGGVQPPLDAMVEQGLLEKPVFSFYLNRDSEGSDGGELVLGGSDPAHYVPPLTFIPVTIPAYWQVHMESVKVGTGLSLCAQGCSAILDTGTSLITGPSEEIRALNKAIGGYPFLNGQYFIQCSKTPTLPPVSFHLGGVWFNLTGQDYVIKILQSDVGLCLLGFQALDIPKPAGPLWILGDVFLGPYVAVFDRGDKNVGPRVGLARAQSRSTDRAERRTTQAQFFKRRPG

SEQ ID NO: 543 - protein, 420 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 544 - protein, 155 aa, Mus musculus
MGPKLLESRLCLLLLLGLVLMLASCLGQTPSQKFAIQHINNNTNLQCNVEMMRINRARRTCKGLNTFLHTSFANAVGVCGNPSGLCSDKRSQNCHNSSSRVHITVCNITSRATNYTQCRYQSRRSLEYYTVACDPRTPQDSPMYPVVPVHLDGTF

SEQ ID NO: 545 - protein, 486 aa, Mus musculus
MWKSVVGHDVSVSVETQGDDWDTDPDFVNDISEKEQRWGAKTIEGSGRTEHINIHQLRNKVSEEHDILKKKELESGPKASHGYGGQFGVERDRMDKSAVGHEYVADVEKHSSQTDAARGFGGKYGVERDRADKSAVGFDYKGEVEKHASQKDYSHGFGGRYGVEKDKRDKAALGYDYKGETEKHESQRDYAKGFGGQYGIQKDRVDKSAVGFNEMEAPTTAYKKTTPIEAASSGARGLKAKFESLAEEKRKREEEEKAQQMARQQQERKAVVKMSREVQQPSMPVEEPAAPAQLPKKISSEVWPPAESHLPPESQPVRSRREYPVPSLPTRQSPLQNHLEDNEEPPALPPRTPEGLQVVEEPVYEAAPELEPEPEPDYEPEPETEPDYEDVGELDRQDEDAEGDYEDVLEPEDTPSLSYQAGPSAGAGGAGISAIALYDYQGEGSDELSFDPDDIITDIEMVDEGWWRGQCRGHFGLFPANYVKLL

SEQ ID NO: 546 - protein, 486 aa, Homo sapiens [sequence omitted]

SEQ ID NO: 547 - protein, 158 aa, Mus musculus
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGII

SEQ ID NO: 548 - protein, 158 aa, Homo sapiens
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 549 - protein, 60 aa, Mus musculus
KLFDSICNNKWFTDTSIILFLNKKDLFEEKIKKSPLTICYPEYAGSNTYEEAAAYIQCQF

SEQ ID NO: 550 - protein, 355 aa, Homo sapiens
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 551 - protein, 264 aa, Mus musculus
MESGFTSKDTYLSHFNPRDYLEKYYSFGSRHCAENEILRHLLKNLFKIFCLGAVKGELLIDIGSGPTIYQLLSACESFTEIIVSDYTDQNLWELQKWLKKEPGAFDWSPVVTYVCDLEGNRMKGPEKEEKLRRAIKQVLKCDVTQSQPLGGVSLPPADCLLSTLCLDAACPDLPAYRTALRNLGSLLKPGGFLVMVDALKSSYYMIGEQKFSSLPLGWETVRDAVEEAGYTIEQFEVISQNYSSTTSNNEGLFSLVGRKPGRSE

SEQ ID NO: 552 - protein, 264 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVTQSQPLGAVPLPPADCVLSTLCLDAACPDLPTYCRALRNLGSLLKPGGFLVIMDALKSSYYMIGEQKFSSLPLGREAVEAAVKEAGYTIEWFEVISQSYSSTMANNEGLFSLVARKLSRPL

SEQ ID NO: 553 - protein, 219 aa, Mus musculus bactrianus
MLRAGAPTAGSFRTEEVHTGTTIMAVEFDGGVVVGSDSRVSAGTAVVNRVFDKLSPLHQRIFCALSGSAADAQAIADMAAYQLELHGLELEEPPLVLAAANVVKNISYKYREDLLAHLIVAGWDQREGGQVYGTMGGMLIRQPFTISGSGSSYIYGYVDAAYKPGMTPEECRRFTTNAITLAMNRDGSSGGVIYLVTITAAGVDHRVILGDELPKFYDE

SEQ ID NO: 554 - protein, 219 aa, Homo sapiens
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 555 - protein, 589 aa, Mus musculus
MASEIHMSEPMCLIENTEAQLVINQEALRILSAITQPVVVVAIVGLYRTGKSYLMNKLAGKRTGFSLGSTVQSHTKGIWMWCVPHPKKAGQTLVLLDTEGLEDVEKGDNQNDCWIFALAVLLSSTFIYNSIGTINQQAMDQLHYVTELTDLIKSKSSPDQSGVDDSANFVGFFPTFVWTLRDFSLELEVNGKPVTSDEYLEHSLTLKKGADKKTKSFNEPRLCIRKFFPKRKCFIFDRPAQRKQLSKLETLREEELCGEFVEQVAEFTSYILSYSSVKTLCGGIIVNGPRLKSLVQTYVGAISNGSLPCMESAVLTLAQIENSAAVQKAITHYEEQMNQKIQMPTETLQELLDLHRPIESEAIEVFLKNSFKDVDQKFQTELGNLLVAKRDAFIKKNMDVSSARCSDLLEDIFGPLEEEVKLGTFSKPGGYYLFLQMRQELEKKYNQAPGKGLQAEAMLKNYFDSKADVVETLLQTDQSLTEAAKEVEEERTKAEAAEAANRELEKKQKEFELMMQQKEKSYQEHVKKLTEKMKDEQKQLLAEQENIIAAKLREQEKFLKEGFENESKKLIREIDTLKQNKSSGKCTIL

SEQ ID NO: 556 - protein, 591 aa, Homo sapiens
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIPVNGPRLESLVLTYVNAISSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLQELKNKYYQVPRKGIQAKEVLKKYLESKEDVADALLQTDQSLSEKEKAIEVERIKAESAEAAKKMLEEIQKKNEEMMEQKEKSYQEHVKQLTEKMERDRAQLMAEQEKTLALKLQEQERLLKEGFENESKRLQKDIWDIQMRSKSLEPICNIL

SEQ ID NO: 557 - protein, 253 aa, Mus musculus
SGSYPSPKGIHPFLLLALVVGGAVQASKIVGGHEARPHSRPYVASLQLSRFPGSHFCGGTLIHPRFVLTAAHCLQDISWQLVTVVLGAHDLLSSEPEQQKFTISQVFQNNYNPEENLNDVLLLQLNRTASLGKEVAVASLPQQDQTLSQGTQCLAMGWGRLGTQAPTPRVLQELNVTVVTFLCREHNVCTLVPRRAAGICFGDSGGPLICNGILHGVDSFVIRECASLQFPDFFARVSMYVDWIQNVLRGAEP

SEQ ID NO: 558 - protein, 256 aa, Homo sapiens
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 559 - protein, 71 aa, Mus musculus
MASNNTASIAQARKLVEQLKMEANIDRIKVSKAAADLMAYCEAHAKEDPLLTPVPASENPFREKKFFCAIL

SEQ ID NO: 560 - protein, 896 aa, Mus musculus
MDQQMALTWGLCYMALVALCWGHGVTEAEETVPLKTLQCYNDYTNHIICSWADTEDAQGLINMTLYHQLEKKQPVSCELSEKLMWSECPSSHRCVPRRCVIPYTRFSITNEDYYSFRPDSDLGIQLMVPLAQNVQPPLPKNVSISSSEDRFLLEWSVSLGDAQVSWLSSKDIEFEVAYKRLQDSWEDAYSLHTSKFQVNFEPKLFLPNSIYAPRVRTRLYPGSSLSGRPSRWSPEAHWDSQPGDKAQPQNLQCFFDGIQSLHCSWEVWTQTTGSVSFGLFYRPSPVAPEEKCSPVVKEPPGASVYTRYHCSLPVPEPSAHSQYTVSVKHLEQGKFIMSYNHIQMEPPTLNLTKNRDSYSLHWETQKMAYSFIEHTFQVQYKKKSDSWEDSKTENLDRAHSMDLSQLEPDTSYCARVRVKPISNYDGIWSKWSEEYTWKTDWVMPTLWIVLILVFLILTLLLILRFGCVSVYRTYRKWKEKIPNPSKSLLFQDGGKGLWPPGSMAAFATKNPALQGPQSRLLAEQQGESYAHLEDNNVSPLTIEDPNIIRVPPSGPDTTPAASSESTEQLPNVQVEGPTPNRPRKQLPSFDFNGPYLGPPQSHSLPDLPDQLGSPQVGGSLKPALPGSLEYMCLAPGGQVQLVPLSQVMGQGQAMDVQCGSSLETSGSPSVEPKENPPVELSMEEQEARDNPVTLPISSGGPEGSMMASDYVTPGDPVLTLPTGPLSTSLGPSLGLPSAQSPSLCLKLPRVPSGSPALGPPGFEDYVELPPSVSQAAKSPPGHPAPPVASSPTVIPGEPREEVGPASPHPEGLLVLQQVGDYCFLPGLGPGSLSPHSKPPSPSLCSETEDLVQDLSVKKFPYQPMPQAPAIQFFKSLKHQDYLSLPPWDNSQSGKVC

SEQ ID NO: 561 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 562 - protein, 1343 aa, Mus musculus
MGLWLKLLAFGFALLDTEVFVTGQTPTPSDELSTTENALLLPQSDPLPARTTESTPPSISERGNGSSETTYHPGVLSTLLPHLSPQPDSQTPSAGGADTQTFSSQADNPTLTPAPGGGTDPPGVPGERTVPGTIPADTAFPVDTPSLARNSSAASPTHTSNVSTTDISSGASLTTLTPSTLGLASTDPPSTTIATTTKQTCAAMFGNITVNYTYESSNQTFKADLKDVQNAKCGNEDCENVLNNLEECSQIKNISVSNDSCAPATTIDLYVPPGTDKFSLHDCTPKEKANTSICLEWKTKNLDFRKCNSDNISYVLHCEPENNTKCIRRNTFIPERCQLDNLRAQTNYTCVAEILYRGVKLVKNVINVQTDLGIPETPKPSCGDPAARKTLVSWPEPVSKPESASKPHGYVLCYKNNSEKCKSLPNNVTSFEVESLKPYKYYEVSLLAYVNGKIQRNGTAEKCNFHTKADRPDKVNGMKTSRPTDNSINVTCGPPYETNGPKTFYILVVRSGGSFVTKYNKTNCQFYVDNLYYSTDYEFLVSFHNGVYEGDSVIRNESTNFNAKALIIFLVFLIIVTSIALLVVLYKIYDLRKKRSSNLDEQQELVERDDEKQLMDVEPIHSDILLETYKRKIADEGRLFLAEFQSIPRVFSKFPIKDARKPHNQNKNRYVDILPYDYNRVELSEINGDAGSTYINASYIDGFGFKEPRKYIAAQGTRAPGPRDETVDDFWRMIWEQKATVIVMVTRCEEGNRNRNKCNKCAEYWPSMEEGTRAFKDIVVTINDHKRCPDYIIQKLNVAHAHKKKKEKATGREVTHIQFTSWPDHGVPEDPHLLLKLRRRVNAFSNFFSGPIVVHCSTAVLVAGVGRTGTYIGIDAMLEGLEAEGKVDVYGYVVKLRRQRCLMVQVEVEAQYAQYILIHQALVEYNQFGETEVNLSELHSCLHNMKKRDPPSDPSPLEAEYQYQRLRLPSYRSWRTQHIGNQEENKKKNRNSNVVPYDFNRVPLKHELEMSKESEPESDESSDDDSDSEETSKYINASFVMSYWSYWKPEMMIAAQGPLKETIGDFWQMIFQRKVKVIVMLTELVNGDQDQEVCEVCAQYWGEGKQTYGDMEVEMKDTNRASAYTLRTFELRHSKSKRKRKEPRTVYQYQCTTWKGEELPAEPKDLVSMIQDLKQKLPKASPEGMKYHKHASILVHCSTAEMEDGSQQTGLFCALFNLLESAETEDVVDVFQVVKSLRKARPGVVCSYSYEQYEQYQFLYDIIASIYPAQNGQVKKTNSQDKIEFHNEVDGGKQDANCVRPDGPLNKAQEDSRGVGTPEPTNSAEEPEHAANGSASPAPTQSS

SEQ ID NO: 563 - protein, 1304 aa, Homo sapiens [sequence omitted]

SEQ ID NO: 564 - protein, 437 aa, Mus musculus
MLLLLARCFLVILASSLLVCPGLACGPGRGFGKRRHPKKLTPLAYKQFIPNVAEKTLGASGRYEGKITRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLRPGDRVLAADDQGRLLYSDFLTFLDRDEGAKKVFYVIETLEPRERLLLTAAHLLFVAPHNDSGPTPGPSALFASRVRPGQRVYVVAERGGDRRLLPAAVHSVTLREEEAGAYAPLTAHGTILINRVLASCYAVIEEHSWAHRAFAPFRLAHALLAALAPARTDGGGGGSIPAAQSATEARGAEPTAGIHWYSQLLYHIGTWLLDSETMHPLGMAVKSS

SEQ ID NO: 565 - protein, 462 aa, Homo sapiens
MLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 566 - protein, 509 aa, Mus musculus
MEPAGPAPGRLGPLLLCLLLSASCFCTGATGTEVKVTQPEKSVSVAAGDSTILNCTVTSLLPVGPIRWYRGVGQSRLLIYSFTGEHFPRVRNVSDTTKRNNMDFSIRISNVTPEDAGTYYCVKFQRGSSEPDTEIQSGGGTEVYVLAKPSPPEVSGPADRGIPDQKVNFTCKSHGFSPRNITLKWFKDGQELHPLETTVNPSGKNVSYNISSTVRVVLNSMDVNSKVICEVAHITLDRSPLRGIANLSNFIRVSPTVKVTQQPPTSMNQVNLTCRAERFYPEDLQLIWLENGNVSRNDTPKNLTKNTDGTYNYTSLFLVNSSAHREDVVFTCQVKHDQQPAITRNHTVLGLAHSSDQGSMQTFPGNNATHNWNVFIGVGVACALLVVLLMAALYLLRIKQKKAKGSTSSTRLHEPEKNAREITQIQDTNDINDITYADLNLPKEKKPAPRAPEPNNHTEYASIETGKVPRPEDTLTYADLDMVHLNRAQPAPKPEPSFSEYASVQVQRK

SEQ ID NO: 567 - protein, 504 aa, Homo sapiens
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 568 - protein, 510 aa, Mus musculus
MIFRDHSILIMASLHFPQWAVSFVFFAQAVGSMDTFIAAVYEHAVILPNKTESPVSTEEALLLINKNIDILESAIKLAARQGAHIIVTPEDGIYGWIFTRETIYPYLEDIPDPEVNWIPCRDPRRFGYTPVQERLSCLAKENSIYIMANIGDKKPCNATDPHCPPDGRYQYNTNVVFDSKGRLTARYHKYNLFEPEIQFDFPKDSELVTFDTPFGKFGIFTCFDIFSYDPAVVVVKDTQVDSVLLPTAWYNTLPLLSAVPFHSVWARAMGVNVLAANTHNTSMHMTGSGIYSPEAVRVYHYDMETESGQLLLSELRSRPRQHATPAEVNWSAYARTVKPFSSGQADFPGKIYFDEFSFTKLTGSAGNYTVCQKDLCCHLTYKMSESRMDEVYVLGAFDGLHTGEGQYYLQICTLLKCQTTNSRTCGEPVGSAFTKFEEFSLSGTFRTKYVFPQIVLSGSQLALERYYEVSRDGRLRSRGGAPLPILVMALYGRVFERDPPRLGQGPGKLQ

SEQ ID NO: 569 - protein, 501 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAAVVVDEVSIDSILYPTAWYNTLPLLSAVPFHSAWAKAMGVNLLAANTHNTSMHMTGSGIYAPEAVKVYHYDMETESGQLLLSELKSRPRREPTYPAAVDWHAYASSVKPFSSEQSDFLGMIYFDEFTFTKLKRNTGNYTACQKDLCCHLTYKMSEKRTDEIYALGAFDGLHTVEGQYYLQICALLKCQTTDLETCGEPVGSAFTKFEDFSLSGTFGTRYVFPQIILSGSQLAPERHYEISRDGRLRSRSGAPLPVLVMALYGRVFEKDPPRLGQGSGKFQ

SEQ ID NO: 570 - protein, 301 aa, Mus musculus
MDVLASYSIFQELQLVHDTGYFSALPSLEETWQQTCLELERYLQTEPRRISETFGEDLDCFLHASPPPCIEESFRRLDPLLLPVEATICEKSSAVDILLSRDKLLSETCLSLQPTSSSLDSYTAVNQAQLNAVTSLTPPSSPELSRHLVKTSQTLSAVDGTVTLKLVAKKASLSPVKVGGVAAAAAVTPAGAVKSGQSDSEQGGGGADTCPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 571 - protein, 302 aa, Homo sapiens
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 572 - protein, 1202 aa, Mus musculus
MGNLKSVGQEPGPPCGLGLGLGLGLCGKQGPASPAPEPSQAPAPPSPTRAAPDHSPPLTRPPDGPRFPRVKNWEVGSITYDTLSAQAQQDGPCTSRRCLGSLVFPRKLQSRPTQGPSPTEQLLGQARDFINQYYNSIKRSGSQAHEQRLQEVEAEVAATGTYQLRESELVFGAKQAWRNAPRCVGRIQWGKLQVFDARDCRTAQEMFTYICNHIKYATNRGNLRSAITVFPQRCPGRGDFRIWNSQLIRYAGYRQQDGSVRGDPANVEITELCIQHGWTPGNGRFDVLPLLLQAPDESPELFTLPPEMVLEVPLEHPTLEWFAALGLRWYALPAVSNMLLEIGGLEFPAAPFSGWYMSSEIGMRDLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGAGITRKKTFKEVANAVKISASLMGTVMAKRVKATILYGSETGRAQSYAQQLGRLFRKAFDPRVLCMDEYDVVSLEHEALVLVVTSTFGNGDPPENGESFAAALMEMSGPYNSSPRPEQHKSYKIRFNSVSCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSTQAESLQLLPGLTHVHRRKMFQATILSVENLQSSKSTRATILVRLDTGGQEGLQYQPGDHIGVCPPNRPGLVEALLSRVEDPPPSTEPVAVEQLEKGSPGGPPPGWVRDPRLPPCTLRQALTYFLDITSPPSPRLLRLLSTLAEESSEQQELEALSQDPRRYEEWKWFSCPTLLEVLEQFPSVALPAPLILTQLPLLQPRYYSVSSAPSAHPGEIHLTIAVLAYRTQDGLGPLHYGVCSTWMSQLKAGDPVPCFIRGAPSFRLPPDPNLPCILVGPGTGIAPFRGFWQDRLHDIEIKGLQPAPMTLVFGCRCSQLDHLYRDEVLDAQQRGVFGQVLTAFSRDPGSPKTYVQDLLRTELAAEVHRVLCLEQGHMFVCGDVTMATSVLQTVQRILATEGGMELDEAGDVIGVLRDQQRYHEDIFGLTLRTQEVTSRIRTQSFSLQERQLRGAVPWSFDPPGPEIPGS

SEQ ID NO: 573 - protein, 1203 aa, Homo sapiens
MGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDEPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESFAAALMEMSGPYNSSPRPEQHKSYKIRFNSISCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGAPSFRLPPDPSLPCILVGPGTGIAPFRGFWQERLHDIESKGLQPTPMTLVFGCRCSQLDHLYRDEVQNAQQRGVFGRVLTAFSREPDNPKTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 574 - protein, 680 aa, Mus musculus
MSCTFTALLRLGLTLSLWIPVLTGSLPKPILRVQPDSVVSRWTKVTFFCEETIGANEYRLYKDGKLYKTVTKNKQKPANKAEFSLSNVDLRNAGQYRCSYSTQYKSSGYSDPLELVVTGDYWTPSLLAQASPVVTSGGYVTLQCESWHNDHKFILTVEGPQKLSWTQDSQYNYSTRKYHALFSVGPVTPNQRWICRCYSYDRNRPYVWSPPSESVELLVSGNLQKPTIKAEPGPVIASKRAMTIWCQGNLDAEVYFLHNEGSQKTQSTQTLQQPGNKGKFFIPSMTRQHAGQYRCYCYGSAGWSQPSDTLELVVTGIYEHYKPRLSVLPSPVVTAGGNMTLHCASDFHYDKFILTKEDKKFGNSLDTEHISSSRQYRALFIIGPTTPTHTGTFRCYGYFKNAPQLWSVPSDLQQILISGLSKKPSLLTHQGHILDPGMTLTLQCFSDINYDRFALHKVGGADIMQHSSQQTDTGFSVANFTLGYVSSSTGGQYRCYGAHNLSSEWSASSEPLDILITGQLPLTPSLSVKPNHTVHSGETVSLLCWSMDSLDTFILSKEGSTQQPLQLKSKSHDQQSQAEFSMSAVTSHLSGTYRSYGAQDSSFYLLSSASAPVELTVSETIESSTWSPKRPIPPIPTENKDHTMENLIRMGMAVLVLIVLSILATEAWRSHRQTHPAAGN

SEQ ID NO: 575 - protein, 510 aa, Homo sapiens
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSSPAQLPTPRKKTSMLP

SEQ ID NO: 576 - protein, 64 aa, Mus musculus
YGIHRVRDHDVRAHCGVDHMACGRDGVLLQEDCCCYGGCCTRERLRIPGHYIREQRKLYRRPGG

SEQ ID NO: 577 - protein, 218 aa, Homo sapiens
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSEIMMYVLIVVLTIWLVAEMIYCYKKIAAATETAAQENASEYLAITSESKENCTGVQVAE

SEQ ID NO: 578 - protein, 373 aa, Mus musculus
MEDNNMLPQFIHGILSTSHSLFTRSIQELDEGATTPYDYDDGEPCHKTSVKQIGAWILPPLYSLVFIFGFVGNMLVIIILIGCKKLKSMTDIYLLNLAISDLLFLLTLPFWAHYAANEWVFGNIMCKVFTGLYHIGYFGGIFFIILLTIDRYLAIVHAVFALKARTVTFGVITSVVTWVVAVFASLPGIIFTKSKQDDHHYTCGPYFTQLWKNFQTIMRNILSLILPLLVMVICYSGILHTLFRCRNEKKRHRAVRLIFAIMIVYFLFWTPYNIVLFLTTFQESLGMSNCVIDKHLDQAMQVTETLGMTHCCINPVIYAFVGEKFRRYLSIFFRKHIAKRLCKQCPVFYRETADRVSSTFTPSTGEQEVSVGL

SEQ ID NO: 579 - protein, 360 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 580 - protein, 449 aa, Mus musculus
MNLETGSRGSEFGMSAVSCGNGKLRQWLIDQIDSGKYPGLVWENEEKSVFRIPWKHAGKQDYNREEDAALFKAWALFKGKFREGIDKPDPPTWKTRLRCALNKSNDFEELVERSQLDISDPYKVYRIVPEGAKKGAKQLTLDDTQMAMGHPYPMTAPYGSLPAQVHNYMMPPHDRSWRDYAPDQSHPEIPYQCPVTFGPRGHHWQGPSCENGCQVTGTFYACAPPESQAPGIPIEPSIRSAEALALSDCRLHICLYYRDILVKELTTTSPEGCRISHGHTYDVSNLDQVLFPYPDDNGQRKNIEKLLSHLERGLVLWMAPDGLYAKRLCQSRIYWDGPLALCSDRPNKLERDQTCKLFDTQQFLSELQVFAHHGRPAPRFQVTLCFGEEFPDPQRQRKLITAHVEPLLARQLYYFAQQNTGHFLRGYELPEHVTTPDYHRSLRHSSIQE

SEQ ID NO: 581 - protein, 451 aa, Homo sapiens
MNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 582 - DNA, 1 bp, Missing
a

SEQ ID NO: 583 - protein, 166 aa, Homo sapiens
MTVPLNGVIRQHKTDKPDQDFSEGAQFFLKSKKQKSLSVGVCLRHNGLVLIKGPFILFAEKVKSTAGHASGVVLWQPQSQCGPYKVFLKDLSSTPMASNNTASIAQARKLVEQLKMEANIDRIKVSKAAADLMAYCEAHAKEDPLLTPVPASENPFREKKFFCAIL

SEQ ID NO: 584 - DNA, 1 bp, Place holder
a

SEQ ID NO: 585 - DNA, 1 bp, Place holder
a

SEQ ID NO: 586 - DNA, 1 bp, Place holder
a

SEQ ID NO: 587 - DNA, 1 bp, Place holder
a

SEQ ID NO: 588 - DNA, 1 bp, Place holder
a

SEQ ID NO: 589 - DNA, 1 bp, Place holder
a

SEQ ID NO: 590 - DNA, 1 bp, Place holder
a

SEQ ID NO: 591 - DNA, 1 bp, Place holder
a

SEQ ID NO: 592 - protein, 445 aa, Rat
MGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 593 - DNA, 1 bp, Place holder
a

SEQ ID NO: 594 - DNA, 1 bp, Place holder
a

SEQ ID NO: 595 - DNA, 1 bp, Place holder
a

SEQ ID NO: 596 - DNA, 1 bp, Place holder
a

SEQ ID NO: 597 - DNA, 1 bp, Place holder
a

SEQ ID NO: 598 - DNA, 1 bp, Place holder
a

SEQ ID NO: 599 - DNA, 1 bp, Place holder
a

SEQ ID NO: 600 - protein, 160 aa, Human
MRTAAGAVSPDSRPETRRQTRKNEEAAWGPRVCRAEREDNRKCPPSILKRSRPEHHRPEAKPQRTSRRVWFREPPAVTVHYIADKNATATVRVPGRPRPHGGSLLLQLCVCVLLVLALGLYCGRAKPVATALEDLRARLLGLVLHLRHVALTCWRGLLRL

SEQ ID NO: 601 - DNA, 1 bp, Place holder
a

SEQ ID NO: 602 - DNA, 1 bp, Place holder
a

SEQ ID NO: 603 - DNA, 1 bp, Place holder
a

SEQ ID NO: 604 - DNA, 1 bp, Place holder
a

SEQ ID NO: 605 - DNA, 1 bp, Place holder
a

SEQ ID NO: 606 - DNA, 1 bp, Place holder
a

SEQ ID NO: 607 - DNA, 1 bp, Place holder
a

SEQ ID NO: 608 - DNA, 1 bp, Place holder
a

SEQ ID NO: 609 - DNA, 1 bp, Place holder
a

SEQ ID NO: 610 - protein, 824 aa, Human
GDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGQGMSREL

SEQ ID NO: 611 - DNA, 1 bp, Place holder
a

SEQ ID NO: 612 - DNA, 1 bp, Place holder
a

SEQ ID NO: 613 - DNA, 1 bp, Place holder
a

SEQ ID NO: 614 - DNA, 1 bp, Place holder
a

SEQ ID NO: 615 - DNA, 1 bp, Place holder
a

SEQ ID NO: 616 - DNA, 1 bp, Place holder
a

SEQ ID NO: 617 - DNA, 1 bp, Place holder
a

SEQ ID NO: 618 - DNA, 1 bp, Place holder
a

SEQ ID NO: 619 - protein, 312 aa, Rat
VTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 620 - DNA, 1 bp, Place holder
a

SEQ ID NO: 621 - DNA, 1 bp, Place holder
a

SEQ ID NO: 622 - DNA, 1 bp, Place holder
a

SEQ ID NO: 623 - DNA, 1 bp, Place holder
a

SEQ ID NO: 624 - DNA, 1 bp, Place holder
a

SEQ ID NO: 625 - DNA, 1 bp, Place holder
a

SEQ ID NO: 626 - DNA, 1 bp, Place holder
a

SEQ ID NO: 627 - DNA, 1 bp, Place holder
a

SEQ ID NO: 628 - DNA, 1 bp, Place holder
a

SEQ ID NO: 629 - DNA, 1 bp, Place holder
a

SEQ ID NO: 630 - DNA, 1 bp, Place holder
a

SEQ ID NO: 631 - DNA, 1 bp, Place holder
a

SEQ ID NO: 632 - DNA, 1 bp, Place holder
a

SEQ ID NO: 633 - protein, 950 aa, Human
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 634 - DNA, 1 bp, Place holder
a

SEQ ID NO: 635 - DNA, 1 bp, Place holder
a

SEQ ID NO: 636 - DNA, 1 bp, Place holder
a

SEQ ID NO: 637 - DNA, 1 bp, Place holder
a

SEQ ID NO: 638 - DNA, 1 bp, Place holder
a

SEQ ID NO: 639 - DNA, 1 bp, Place holder
a

SEQ ID NO: 640 - DNA, 1 bp, Place holder
a

SEQ ID NO: 641 - DNA, 1 bp, Place holder
a

SEQ ID NO: 642 - DNA, 1 bp, Place holder
a

SEQ ID NO: 643 - DNA, 1 bp, Place holder
a

SEQ ID NO: 644 - DNA, 1 bp, Place holder
a

SEQ ID NO: 645 - DNA, 1 bp, Place holder
a

SEQ ID NO: 646 - DNA, 1 bp, Place holder
a

SEQ ID NO: 647 - DNA, 1 bp, Place holder
a

SEQ ID NO: 648 - DNA, 1 bp, Place holder
a

SEQ ID NO: 649 - DNA, 1 bp, Place holder
a

SEQ ID NO: 650 - DNA, 1 bp, Place holder
a

SEQ ID NO: 651 - DNA, 1 bp, Place holder
a

SEQ ID NO: 652 - DNA, 1 bp, Place holder
a

SEQ ID NO: 653 - protein, 381 aa, Rat
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 654 - DNA, 1 bp, Place holder
a

SEQ ID NO: 655 - DNA, 1 bp, Place holder
a

SEQ ID NO: 656 - DNA, 1 bp, Place holder
a

SEQ ID NO: 657 - DNA, 1 bp, Place holder
a

SEQ ID NO: 658 - DNA, 1 bp, Place holder
a

SEQ ID NO: 659 - DNA, 1 bp, Place holder
a

SEQ ID NO: 660 - DNA, 1 bp, Place holder
a

SEQ ID NO: 661 - DNA, 1 bp, Place holder
a

SEQ ID NO: 662 - DNA, 1 bp, Place holder
a

SEQ ID NO: 663 - DNA, 1 bp, Place holder
a

SEQ ID NO: 664 - DNA, 1 bp, Place holder
a

SEQ ID NO: 665 - DNA, 1 bp, Place holder
a

SEQ ID NO: 666 - DNA, 1 bp, Place holder
a

SEQ ID NO: 667 - DNA, 1 bp, Place holder
a

SEQ ID NO: 668 - DNA, 1 bp, Place holder
a

SEQ ID NO: 669 - DNA, 1 bp, Place holder
a

SEQ ID NO: 670 - DNA, 1 bp, Place holder
a

SEQ ID NO: 671 - DNA, 1 bp, Place holder
a

SEQ ID NO: 672 - DNA, 1 bp, Place holder
a

SEQ ID NO: 673 - DNA, 1 bp, Place holder
a

SEQ ID NO: 674 - DNA, 1 bp, Place holder
a

SEQ ID NO: 675 - DNA, 1 bp, Place holder
a

SEQ ID NO: 676 - DNA, 1 bp, Place holder
a

SEQ ID NO: 677 - DNA, 1 bp, Place holder
a

SEQ ID NO: 678 - DNA, 1 bp, Place holder
a

SEQ ID NO: 679 - DNA, 1 bp, Place holder
a

SEQ ID NO: 680 - DNA, 1 bp, Place holder
a

SEQ ID NO: 681 - DNA, 1 bp, Place holder
a

SEQ ID NO: 682 - DNA, 1 bp, Place holder
a

SEQ ID NO: 683 - DNA, 1 bp, Place holder
a

SEQ ID NO: 684 - DNA, 1 bp, Place holder
a

SEQ ID NO: 685 - DNA, 1 bp, Place holder
a

SEQ ID NO: 686 - DNA, 1 bp, Place holder
a

SEQ ID NO: 687 - DNA, 1 bp, Place holder
a

SEQ ID NO: 688 - DNA, 1 bp, Place holder
a

SEQ ID NO: 689 - DNA, 1 bp, Place holder
a

SEQ ID NO: 690 - DNA, 1 bp, Place holder
a

SEQ ID NO: 691 - DNA, 1 bp, Place holder
a

SEQ ID NO: 692 - DNA, 1 bp, Place holder
a

SEQ ID NO: 693 - DNA, 1 bp, Place holder
a

SEQ ID NO: 694 - DNA, 1 bp, Place holder
a

SEQ ID NO: 695 - DNA, 1 bp, Place holder
a

SEQ ID NO: 696 - DNA, 1 bp, Place holder
a

SEQ ID NO: 697 - DNA, 1 bp, Place holder
a

SEQ ID NO: 698 - DNA, 1 bp, Place holder
a

SEQ ID NO: 699 - DNA, 1 bp, Place holder
a

SEQ ID NO: 700 - DNA, 1 bp, Place holder
a

SEQ ID NO: 701 - DNA, 1 bp, Place holder
a

SEQ ID NO: 702 - DNA, 1 bp, Place holder
a

SEQ ID NO: 703 - protein, 111 aa, Rat
MGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 704 - DNA, 1 bp, Place holder
a

SEQ ID NO: 705 - DNA, 1 bp, Place holder
a

SEQ ID NO: 706 - DNA, 1 bp, Place holder
a

SEQ ID NO: 707 - DNA, 1 bp, Place holder
a

SEQ ID NO: 708 - DNA, 1 bp, Place holder
a

SEQ ID NO: 709 - DNA, 1 bp, Place holder
a

SEQ ID NO: 710 - DNA, 1 bp, Place holder
a

SEQ ID NO: 711 - protein, 1432 aa, Human
MSWNAKPENAVAKPPKFSKTQSSILQQFLMTSTTSQSSFSYPAHNQEACMYSSNSNSVSQPLLSGRNYMTPQTQISVSNMPSRTIVTSQSSMEGVVCTNVKGPQQPNHNLQTVSSGVMQNVWFGSSVKNFMPSHTEATISHNPDGRTNMPYMQTPQSQLVTSDTYSMQLQMVPFNSGKVPVAYQGNQGLNHFIPDQLADWTQYTSSELTYPEYRPPLKQYSRILPATTSLQVKNNPLPTYTQALQSKHSAPLSSHPYAAETSKRLSALPYSCRYGSQHVQNTQPVSKHLPMEVPQSPEVHSSEKKQDSYRGFKQQWQNPNESFTIGKFSDLKINAKQSYSDTVRSSGDGVQALVQNNQEKRKYPYSPSTNQVIDTNATKEKLARDIKSLVEIKKKFTELARKIKINKSLLMAAGCSKTANTSYTEPIQHSEFSAKEMSAKNGNDCSMELLATCLSLWKNQPPKTTEENVPKPLEEKQCNTSRISTTVVGSSHPTNEVHVKSFCSGVGNSQKLLSSSQTILSVLTPSGESSGVAVGKGTELQIAVVSPLVLADTNPLPGKELAPEVLPEPPYPVVKEGSICSLQHQQAETAALPFHITGVVADSNLSVEMSLPAQKEKQHKPTQGDPDIADHGLGKLSPLGTEAVPNSVDSTTVSGPMLQIESICSLAEGDVSYNSQIAEIFNSVQNEPEKPSPNQVINNQQEQVDGTTENKDFSLQKDKKYIRYTYVPREITEQPEVLQPEEPASCEYVEANTETIEESGRECSGGKESTAEDVCSPAGFQQDPHPQETDSLSNKSAHCLPAVNEINDESEPVSYLHDQLSELLKEFPYGIETVSRHEVSVDQKKTHKILENETGDKTSNVFGDSTDQIKITVLNSEQIKELFPEEDQPCDLDKLAEPEGKNVAEVKSPCDSQVPREESHDFGMLDPEKDKIHCCALGWLSMVYEGVPKCHCSSNEEKGKDQCLDMNSCKQGEQPCNNGITIFEINPVSNNPKTPLTQAAEKGHFSEMHGDKTKGSKTKDSREEQQHFSAKCYKKDKDNLKMRHDSSLKMEQKLKNTSSECDRLNPSKSSKIATPEILHVKTSNSDKNMSFFKQASQESLQRKPTSQDSNPVKAPVELPSNTDPCRRNTSLVQFVSPEKKKLKFKAGGSRLKYFEKRKTDNMIIPDVEIKKKKYEKQEQNKNAGETLKLCSALRESNERASVQENAIPSPESSDSKGSSLKSTRVITVQEYLQRRKDKHVTGSDASGNICVENVLCNSEHMKTSKDSAEISWEKSADGQSIRAETSKEPGHNSTIHGKAFKIHHSEVSRTHSVSSNSKGKQPDKIYKARTSNEHSQVPLQVKEQRKQYLNRVAFKCTERESICLTKLDSASKKLSTEKKESEAHTLKTKNIDKPSMLEFKLCPDVLLKNTSSVDKQDEPEPKKEKAPVQGPV

SEQ ID NO: 712 - DNA, 1 bp, Place holder
a

SEQ ID NO: 713 - DNA, 1 bp, Place holder
a

SEQ ID NO: 714 - DNA, 1 bp, Place holder
a

SEQ ID NO: 715 - DNA, 1 bp, Place holder
a

SEQ ID NO: 716 - DNA, 1 bp, Place holder
a

SEQ ID NO: 717 - DNA, 1 bp, Place holder
a

SEQ ID NO: 718 - DNA, 1 bp, Place holder
a

SEQ ID NO: 719 - DNA, 1 bp, Place holder
a

SEQ ID NO: 720 - DNA, 1 bp, Place holder
a

SEQ ID NO: 721 - DNA, 1 bp, Place holder
a

SEQ ID NO: 722 - DNA, 1 bp, Place holder
a

SEQ ID NO: 723 - DNA, 1 bp, Place holder
a

SEQ ID NO: 724 - DNA, 1 bp, Place holder
a

SEQ ID NO: 725 - DNA, 1 bp, Place holder
a

SEQ ID NO: 726 - protein, 384 aa, Rat
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 727 - DNA, 1 bp, Place holder
a

SEQ ID NO: 728 - DNA, 1 bp, Place holder
a

SEQ ID NO: 729 - DNA, 1 bp, Place holder
a

SEQ ID NO: 730 - DNA, 1 bp, Place holder
a

SEQ ID NO: 731 - DNA, 1 bp, Place holder
a

SEQ ID NO: 732 - DNA, 1 bp, Place holder
a

SEQ ID NO: 733 - DNA, 1 bp, Place holder
a

SEQ ID NO: 734 - DNA, 1 bp, Place holder
a

SEQ ID NO: 735 - DNA, 1 bp, Place holder
a

SEQ ID NO: 736 - DNA, 1 bp, Place holder
a

SEQ ID NO: 737 - DNA, 1 bp, Place holder
a

SEQ ID NO: 738 - DNA, 1 bp, Place holder
a

SEQ ID NO: 739 - DNA, 1 bp, Place holder
a

SEQ ID NO: 740 - DNA, 1 bp, Place holder
a

SEQ ID NO: 741 - DNA, 1 bp, Place holder
a

SEQ ID NO: 742 - DNA, 1 bp, Place holder
a

SEQ ID NO: 743 - DNA, 1 bp, Place holder
a

SEQ ID NO: 744 - DNA, 1 bp, Place holder
a

SEQ ID NO: 745 - DNA, 1 bp, Place holder
a

SEQ ID NO: 746 - DNA, 1 bp, Place holder
a

SEQ ID NO: 747 - DNA, 1 bp, Place holder
a

SEQ ID NO: 748 - DNA, 1 bp, Place holder
a

SEQ ID NO: 749 - DNA, 1 bp, Place holder
a

SEQ ID NO: 750 - protein, 307 aa, Human
MGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

What is claimed is:

1. A method of identifying genes that are over-expressed in adipocytes of white adipose tissue (WAT) from a first animal as compared to preadipocytes in WAT from a second animal comprising performing differential gene expression analysis between the WAT of the first animal and the WAT of the second animal, wherein the first animal is a HMGI-C −/− ob/ob genotype mouse and the second animal is a HMGI-C −/− genotype mouse, and wherein overexpression of a gene in the WAT of the first animal identifies a gene overexpressed in adipocytes.

2. The method of claim 1 wherein the differential gene expression analysis is performed using an Affymetrix Gene-Chip® system.

3. The method of claim 2, wherein the Affymetrix Gene-Chip® system utilizes the MG-U74 chip.

* * * * *